US012723072B2

(12) United States Patent
Buyse et al.

(10) Patent No.: US 12,723,072 B2
(45) **Date of Patent: *Sep. 1, 2026**

(54) IMMUNOGLOBULIN VARIABLE DOMAINS

(71) Applicants: Ablynx N.V., Zwijnaarde (BE); Sanofi, Paris (FR)

(72) Inventors: Marie-Ange Buyse, Merelbeke (BE); Carlo Boutton, Wielsbeke (BE)

(73) Assignees: Ablynx NV, Ghent-Zwijnaarde (BE); Sanofi, Paris (FR)

(*) Notice: Subject to any disclaimer, the term of this patent is extended or adjusted under 35 U.S.C. 154(b) by 117 days.

This patent is subject to a terminal disclaimer.

(21) Appl. No.: 17/697,508

(22) Filed: Mar. 17, 2022

(65) Prior Publication Data

US 2022/0332806 A1 Oct. 20, 2022

Related U.S. Application Data

(62) Division of application No. 16/695,420, filed on Nov. 26, 2019, now Pat. No. 11,312,764, which is a division of application No. 15/311,564, filed as application No. PCT/EP2015/060643 on May 13, 2015, now Pat. No. 12,180,268.

(60) Provisional application No. 62/133,600, filed on Mar. 16, 2015, provisional application No. 62/047,560, filed on Sep. 8, 2014, provisional application No. 62/040,167, filed on Aug. 21, 2014, provisional application No. 62/014,015, filed on Jun. 18, 2014, provisional application No. 61/994,552, filed on May 16, 2014.

(51) Int. Cl.

| | |
|---|---|
| ***C07K 16/18*** | (2006.01) |
| ***C07K 16/00*** | (2006.01) |
| ***C07K 16/24*** | (2006.01) |
| ***C07K 16/28*** | (2006.01) |
| ***C07K 16/30*** | (2006.01) |
| ***C07K 16/32*** | (2006.01) |
| ***C07K 16/42*** | (2006.01) |

(52) U.S. Cl.

CPC .............. *C07K 16/18* (2013.01); *C07K 16/00* (2013.01); *C07K 16/24* (2013.01); *C07K 16/241* (2013.01); *C07K 16/244* (2013.01); *C07K 16/28* (2013.01); *C07K 16/2863* (2013.01); *C07K 16/2866* (2013.01); *C07K 16/2875* (2013.01); *C07K 16/30* (2013.01); *C07K 16/32* (2013.01); *C07K 16/42* (2013.01); *C07K 16/4291* (2013.01); *C07K 2317/22* (2013.01); *C07K 2317/31* (2013.01); *C07K 2317/35* (2013.01); *C07K 2317/565* (2013.01); *C07K 2317/567* (2013.01); *C07K 2317/569* (2013.01); *C07K 2317/76* (2013.01); *C07K 2319/00* (2013.01); *C07K 2319/31* (2013.01)

(58) Field of Classification Search

None

See application file for complete search history.

(56) References Cited

U.S. PATENT DOCUMENTS

| | | | |
|---|---|---|---|
| 4,108,837 | A | 8/1978 | Johnson et al. |
| 5,028,608 | A | 7/1991 | Taylor et al. |
| 5,248,775 | A | 9/1993 | Taylor et al. |
| 5,344,932 | A | 9/1994 | Taylor |
| 5,500,362 | A | 3/1996 | Robinson et al. |
| 5,624,821 | A | 4/1997 | Winter et al. |
| 5,648,260 | A | 7/1997 | Winter et al. |
| 5,821,337 | A | 10/1998 | Carter et al. |
| 7,943,129 | B2 | 5/2011 | Muruganandam et al. |
| 8,097,251 | B2 | 1/2012 | Muyldermans et al. |
| 8,337,845 | B2 | 12/2012 | Park et al. |
| 8,460,888 | B2 | 6/2013 | Lafaye et al. |
| 9,745,372 | B2 | 8/2017 | Buyse et al. |
| 10,323,090 | B2 | 6/2019 | Bowman et al. |
| 10,501,542 | B2 | 12/2019 | Punnonen et al. |
| 10,544,211 | B2 | 1/2020 | Buyse et al. |
| 10,544,222 | B2 | 1/2020 | Punnonen et al. |
| 10,858,418 | B2 | 12/2020 | Baumeister et al. |
| 10,968,271 | B2 | 4/2021 | Buyse |

(Continued)

FOREIGN PATENT DOCUMENTS

| | | | |
|---|---|---|---|
| EA | 014295 | B1 | 10/2010 |
| JP | 2008-539772 | A | 11/2008 |

(Continued)

OTHER PUBLICATIONS

[No Author Listed], Communication of a Notice of Opposition in Application No. EP 15722211.8, mailed Mar. 15, 2021. 55 pages.

(Continued)

*Primary Examiner* — Marianne P Allen

(74) *Attorney, Agent, or Firm* — Wolf, Greenfield & Sacks, P.C.

(57) ABSTRACT

VH domain, in which: (i) the amino acid residue at position 112 is one of K or Q; and/or (ii) the amino acid residue at position 89 is T; and/or (iii) the amino acid residue at position 89 is L and the amino acid residue at position 110 is one of K or Q; and (iv) in each of cases (i) to (iii), the amino acid at position 11 is preferably V; and in which said VH domain contains a C-terminal extension (X)n, in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I).

12 Claims, 112 Drawing Sheets

Specification includes a Sequence Listing.

(56) References Cited

U.S. PATENT DOCUMENTS

| | | | | |
|---|---|---|---|---|
| 11,142,569 | B2 | 10/2021 | Buyse et al. | |
| 11,208,476 | B2 | 12/2021 | Rommelaere et al. | |
| 11,220,539 | B2 | 1/2022 | Buyse et al. | |
| 11,312,764 | B2 | 4/2022 | Buyse et al. | |
| 11,312,765 | B2 | 4/2022 | Buyse et al. | |
| 11,319,364 | B2 | 5/2022 | Buyse et al. | |
| 11,332,519 | B2 | 5/2022 | Buyse | |
| 11,332,525 | B2 | 5/2022 | Rommelaere et al. | |
| 11,485,777 | B2 | 11/2022 | Buyse et al. | |
| 11,485,778 | B2 | 11/2022 | Buyse et al. | |
| 11,708,404 | B2 | 7/2023 | Buyse et al. | |
| 11,753,465 | B2 | 9/2023 | Buyse | |
| 11,897,944 | B2 * | 2/2024 | Staelens | A61P 43/00 |
| 11,897,951 | B2 | 2/2024 | Rommelaere et al. | |
| 12,180,268 | B2 | 12/2024 | Buyse et al. | |
| RE50,682 | E | 12/2025 | Buyse et al. | |
| 2009/0074780 | A1 | 3/2009 | Urech et al. | |
| 2011/0064727 | A9 | 3/2011 | Lazar et al. | |
| 2011/0206660 | A1 | 8/2011 | Blanchetot et al. | |
| 2011/0262438 | A1 | 10/2011 | Descamps et al. | |
| 2012/0244164 | A1 | 9/2012 | Beste et al. | |
| 2013/0019175 | A1 | 1/2013 | Kotler et al. | |
| 2017/0121399 | A1 | 5/2017 | Buyse et al. | |
| 2018/0312583 | A1 | 11/2018 | Buyse | |
| 2018/0327491 | A1 | 11/2018 | Buyse et al. | |
| 2019/0367598 | A1 | 12/2019 | Staelens et al. | |
| 2020/0231662 | A1 | 7/2020 | Buyse et al. | |
| 2020/0283509 | A1 | 9/2020 | Buyse | |
| 2021/0087261 | A1 | 3/2021 | Buyse et al. | |
| 2021/0261653 | A1 | 8/2021 | Buyse et al. | |
| 2021/0269514 | A1 | 9/2021 | Buyse et al. | |
| 2021/0269515 | A1 | 9/2021 | Buyse et al. | |
| 2022/0064281 | A1 | 3/2022 | Rommelaere et al. | |
| 2022/0119512 | A1 | 4/2022 | Buyse et al. | |
| 2022/0251183 | A1 | 8/2022 | Buyse et al. | |
| 2022/0332807 | A1 | 10/2022 | Buyse et al. | |

FOREIGN PATENT DOCUMENTS

| | | | |
|---|---|---|---|
| JP | 2010-531145 | A | 9/2010 |
| JP | 2012-500006 | A | 1/2012 |
| JP | 5047950 | B2 | 10/2012 |
| JP | 2014-505698 | A | 3/2014 |
| JP | 2018-162297 | A | 10/2018 |
| JP | 2024-041939 | A | 3/2024 |
| JP | 7471987 | B2 | 4/2024 |
| KR | 2010-0028575 | A | 3/2010 |
| MX | 2018007581 | A | 11/2020 |
| MX | 383560 | B | 3/2025 |
| WO | WO 94/04678 | A1 | 3/1994 |
| WO | WO 99/42077 | A2 | 8/1999 |
| WO | WO 00/42072 | A2 | 7/2000 |
| WO | WO 2004/041862 | A2 | 5/2004 |
| WO | WO 2004/041863 | A2 | 5/2004 |
| WO | WO 2004/058820 | A2 | 7/2004 |
| WO | WO 2005/017148 | A1 | 2/2005 |
| WO | WO 2005/092925 | A2 | 10/2005 |
| WO | WO 2006/122786 | A2 | 11/2006 |
| WO | WO 2006/122787 | A1 | 11/2006 |
| WO | WO 2007/104529 | A2 | 9/2007 |
| WO | WO 2008/020079 | A1 | 2/2008 |
| WO | WO 2008/071447 | A2 | 6/2008 |
| WO | WO 2008/142164 | A2 | 11/2008 |
| WO | WO 2009/000099 | A2 | 12/2008 |
| WO | WO 2009/004065 | A2 | 1/2009 |
| WO | WO 2009/068625 | A2 | 6/2009 |
| WO | WO 2009/068627 | A2 | 6/2009 |
| WO | WO 2009/138159 | A1 | 11/2009 |
| WO | WO 2009/138494 | A2 | 11/2009 |
| WO | WO 2010/019570 | A2 | 2/2010 |
| WO | WO 2010/066836 | A2 | 6/2010 |
| WO | WO 2010/115995 | A2 | 10/2010 |
| WO | WO 2010/125187 | A2 | 11/2010 |
| WO | WO 2010/136481 | A1 | 12/2010 |
| WO | WO 2010/136492 | A2 | 12/2010 |
| WO | WO 2011/003622 | A1 | 1/2011 |
| WO | WO 2011/073180 | A1 | 6/2011 |
| WO | WO 2011/075861 | A1 | 6/2011 |
| WO | WO 2011/083140 | A1 | 7/2011 |
| WO | WO 2011/131659 | A2 | 10/2011 |
| WO | WO 2011/144749 | A1 | 11/2011 |
| WO | WO 2012/156219 | A1 | 11/2012 |
| WO | WO 2012/175400 | A1 | 12/2012 |
| WO | WO 2012/175741 | A2 | 12/2012 |
| WO | WO 2013/024059 | A2 | 2/2013 |
| WO | WO 2013/059230 | A1 | 4/2013 |
| WO | WO 2013/116296 | A1 | 8/2013 |
| WO | WO 2013/178783 | A1 | 12/2013 |
| WO | WO 2014/004427 | A2 | 1/2014 |
| WO | WO 2014/043509 | A2 | 3/2014 |
| WO | WO 2017/080850 | A1 | 5/2017 |
| WO | WO 2017/081320 | A1 | 5/2017 |
| WO | WO 2021/110817 | A1 | 6/2021 |

OTHER PUBLICATIONS

[No Author Listed], Consolidated List of Cited Opposition Documents for Application No. EP 15722211.8, mailed Mar. 15, 2021. 1 page.

[No Author Listed], Human immunoglobulin heavy chain variable region V3-20 (IGHV@) gene, exons 1-2. IMGT/LIGM-DB Accession No. M99657. May 15, 1995. Updated Jan. 18, 2013. 5 pages.

[No Author Listed], Third Party Observation for EP application No. 15722211.8 dated Jul. 3, 2019.

Arezumand et al., Recombinant expression and purification of human placental growth factor 1 and specific camel heavy chain polyclonal antibody preparation. Saudi J Biol Sci. Jan. 2014;21(1):35-9. doi: 10.1016/j.sjbs.2013.04.008. Epub May 7, 2013.

Boutton, preAb epitope at C-terminus. Ablynx Slide SHow. Apr. 20, 2020. 8 pages.

Decanniere et al., A single-domain antibody fragment in complex with RNase A: non-canonical loop structures and nanomolar affinity using two CDR loops. Structure. Apr. 1999;7(4):361-370. doi: 10.1016/S0969-2126(99)80049-5.

Desmyter et al., Antigen specificity and high affinity binding provided by one single loop of a camel single-domain antibody. J Biol Chem. Jul. 13, 2001;276(28):26285-90. Epub May 7, 2001.

Desmyter et al., Crystal structure of a camel single-domain VH antibody fragment in complex with lysozyme. Nat Struct Biol. 1996;3(9):803-811. doi:10.1038/nsb0996-803.

Diamond et al., Somatic mutation of the T15 heavy chain gives rise to an antibody with autoantibody specificity. Proc Natl Acad Sci U S A. Sep. 1984;81(18):5841-4.

Filpula, Antibody engineering and modification technologies. Biomol Eng. Jun. 2007;24(2):201-15. doi: 10.1016/j.bioeng.2007.03.004. Epub Mar. 31, 2007.

Groot et al., Reverse proteomic antibody screening identifies anti adhesive VHH targeting VLA-3. Mol Immunol. Jun. 2009;46(10):2022-8. doi: 10.1016/j.molimm.2009.03.002. Epub Apr. 8, 2009.

Harmsen et al., Llama heavy-chain V regions consist of at least four distinct subfamilies revealing novel sequence features. Mol Immunol. Aug. 2000;37(10):579-90. doi: 10.1016/s0161-5890(00)00081-x.

Johnson et al., Kabat database and its applications: 30 years after the first variability plot. Nucleic Acids Res. Jan. 1, 2000;28(1);214-8.

Jähnichen et al., CXCR4 nanobodies (VHH-based single variable domains) potently inhibit chemotaxis and HIV-1 replication and mobilize stem cells. Proc Natl Acad Sci U S A. Nov. 23, 2010;107(47):20565-70. doi: 10.1073/pnas.1012865107. Epub Nov. 8, 2010.

Kaliberov et al., Adenoviral targeting using genetically incorporated camelid single variable domains. Lab Invest. Aug. 2014;94(8):893-905. doi: 10.1038/labinvest.2014.82. Epub Jun. 16, 2014. Author Manuscript. 28 pages.

Li et al., Cell-penetrating anti-GFAP VHH and corresponding fluorescent fusion protein VHH-GFP spontaneously cross the blood-brain barrier and specifically recognize astrocytes: application to brain imaging. FASEB J. Oct. 2012;26(10):3969-79. doi: 10.1096/fj.11-201384. Epub Jun. 22, 2012.

(56) References Cited

OTHER PUBLICATIONS

Martin, Chapter 3: Protein sequence and structure analysis of antibody variable domains. Antibody Eng. 2010; 2: 33-53.
Matsuda et al., Structure and physical map of 64 variable segments in the 3'0.8-megabase region of the human immunoglobulin heavy-chain locus. Nat Genet. Jan. 1993;3(1):88-94. doi: 10.1038/ng0193-88.
Maussang et al., Llama-derived single variable domains (nanobodies) directed against chemokine receptor CXCR7 reduce head and neck cancer cell growth in vivo. J Biol Chem. Oct. 11, 2013;288(41):29562-72. doi: 10.1074/jbc.M113.498436. Epub Aug. 26, 2013.
Moghimi et al., Heavy Chain Only Antibodies: A New Paradigm in Personalized HER2+ Breast Cancer Therapy. Bioimpacts. 2013;3(1):1-4. doi: 10.5681/bi.2013.009. Epub Jan. 27, 2013.
Muyldermans et al., Recognition of antigens by single-domain antibody fragments: the superfluous luxury of paired domains. Trends Biochem Sci. Apr. 2001;26(4):230-5.
Muyldermans, Single domain camel antibodies: current status. J Biotechnol. Jun. 2001;74(4):277-302.
Nieba et al., Disrupting the hydrophobic patches at the antibody variable/constant domain interface: improved in vivo folding and physical characterization of an engineered scFv fragment. Protein Eng. Apr. 1997;10(4):435-44. doi: 10.1093/protein/10.4.435.
Ohno et al., Antigen-binding specificities of antibodies are primarily determined by seven residues of VH. Proc Natl Acad Sci U S A. May 1985; 82(9): 2945-2949. doi: 10.1073/pnas.82.9.2945.
Regeneron Pharmaceuticals, Inc., Sequence Listing for WO 2013/116296 (published Aug. 8, 2013). 101 pages.
Regeneron Pharmaceuticals, Inc., Sequence Listing for WO 2014/004427 (published Jan. 3, 2014. 99 pages.
Riechmann et al., Single domain antibodies: comparison of camel VH and camelised domain human VH domains. J. Immunol. Methods. Dec. 10, 1999; 231(1-2):25-38.
Rudikoff et al., Single amino acid substitution altering antigen-binding specificity. Proc Natl Acad Sci U S A. Mar. 1982; 79(6): 1979-1983. doi: 10.1073/pnas.79.6.1979.
Schepens et al., Nanobodies® specific for respiratory syncytial virus fusion protein protect against infection by inhibition of fusion. J Infect Dis. Dec. 1, 2011;204(11):1692-701. doi: 10.1093/infdis/jir622. Epub Oct. 12, 2011.
Shahi et al., Random mutagenesis of BoNT/E Hc nanobody to construct a secondary phage-display library. J Appl Microbiol. Aug. 2014;117(2):528-36. doi: 10.1111/jam.12526. Epub May 16, 2014.
Sharifzadeh et al., Development of oligoclonal nanobodies for targeting the tumor-associated glycoprotein 72 antigen. Mol Biotechnol. Jun. 2013;54(2):590-601. doi: 10.1007/s12033-012-9601-0.
Sheriff et al., Redefining the minimal antigen-binding fragment. Nat Struct Biol. Sep. 1996;3(9):733-6.
Spinelli et al., The crystal structure of a llama heavy chain variable domain. Nat Struct Biol. 1996;3(9):752-757. doi: 10.1038/nsb0996-752.
Stryer, Biochemistry. Chapter 14. 4th ed. W.H. Freeman & Company. New York. Mar. 1, 1995. pp. 368-371.
Wesolowski et al., Single domain antibodies: promising experimental and therapeutic tools in infection and immunity. Med Microbiol Immunol. Aug. 2009;198(3):157-74. doi: 10.1007/s00430-009-0116-7. Epub Jun. 16, 2009.
Yarilin. Principles of Immunology. Medicine. 1999:172-4. Moscow.
[No Author Listed], Amino Acids Reference Chart. Millipore Sigma. Accessible at https://www.sigmaaldrich.com/US/en/technical-documents/technical-article/protein-biology/protein-structural-analysis/amino-acid-reference-chart#ali. Retrieved on Nov. 18, 2022. 8 pages.
[No Author Listed], Comparison of pre-eXisting ADA of recognition of sdAbs with S112 vs. S112K with and without exposed C-termini. Additional data submitted by Patent Boutique LLP in Support of Opposition in Application No. EP 17178990.2. Opposition filed Oct. 25, 2022. Document dated Aug. 22-23, 2022. 6 pages.
[No Author Listed], Statement of Facts and Arguments in Support of Opposition in Application No. EP 17178990.2, filed Oct. 25, 2022. 36 pages.
Barthelemy et al., Comprehensive analysis of the factors contributing to the stability and solubility of autonomous human VH domains. J Biol Chem. Feb. 8, 2008;283(6):3639-3654. doi: 10.1074/jbc.M708536200. Epub Nov. 28, 2007.
Bird et al., Single-chain antigen-binding proteins. Science. Oct. 21, 1988;242(4877):423-6. doi: 10.1126/science.3140379. Erratum in: Science Apr. 28, 1989;244(4903):409.
Chowell et al., Hydrophobicity is a hallmark of immunogenic MHC class I T cell epitopes (APP2P.III). J Immunol. May 1, 2014;192(1 Supplement). 3 pages.
Clynes et al., Fc receptors are required in passive and active immunity to melanoma. Proc Natl Acad Sci U S A. Jan. 20, 1998;95(2):652-6. doi: 10.1073/pnas.95.2.652.
Holliger et al., Engineered antibody fragments and the rise of single domains. Nat Biotechnol. Sep. 2005;23(9):1126-36. doi: 10.1038/nbt1142.
Huston et al., Protein engineering of antibody binding sites: recovery of specific activity in an anti-digoxin single-chain Fv analogue produced in *Escherichia coli*. Proc Natl Acad Sci U S A. Aug. 1988;85(16):5879-83. doi: 10.1073/pnas.85.16.5879.
Kay et al., Phage Display of Peptides and Proteins: A Laboratory Manual. Academic Press. 1st edition. Oct. 28, 1996. 318 pages.
Kim et al., Mutational approaches to improve the biophysical properties of human single-domain antibodies. Biochim Biophys Acta. Nov. 2014;1844(11):1983-2001. doi: 10.1016/j.bbapap.2014.07.008. Epub Jul. 24, 2014.
Kufer et al., A revival of bispecific antibodies. Trends Biotechnol. May 2004;22(5):238-44. doi: 10.1016/j.tibtech.2004.03.006.
Mccafferty et al., Chapter 6: Construction and Screening of Antibody Display Libraries. From Phage Display of Peptides and Proteins: A Laboratory Manual. Academic Press. 1st edition. Oct. 28, 1996. pp. 79-111.
Perchiacca et al., Aggregation-resistant domain antibodies engineered with charged mutations near the edges of the complementarity-determining regions. Protein Eng Des Sel. Oct. 2012;25(10):591-601. doi: 10.1093/protein/gzs042. Epub Jul. 27, 2012.
Ratanji et al., Immunogenicity of therapeutic proteins: influence of aggregation. J Immunotoxicol. Apr.-Jun. 2014;11(2):99-109. doi: 10.3109/1547691X.2013.821564. Epub Aug. 6, 2013.
Rider et al., Chapter 4: Microbiological Methods. From Phage Display of Peptides and Proteins: A Laboratory Manual. Academic Press. 1st edition. Oct. 28, 1996. pp. 55-65.
Shields et al., High resolution mapping of the binding site on human IgG1 for Fc gamma RI, Fc gamma RII, Fc gamma RIII, and FcRn and design of IgG1 variants with improved binding to the Fc gamma R. J Biol Chem. Mar. 2, 2001;276(9):6591-604. doi: 10.1074/jbc.M009483200. Epub Nov. 28, 2000.
Singh et al., Hydrophobic amino acid residues in peptide antigens determine the genetic control of immune responses. Pept Res. Jan.-Feb. 1989;2(1):120-7.
Vincke et al., General strategy to humanize a camelid single-domain antibody and identification of a universal humanized nanobody scaffold. J Biol Chem. Jan. 30, 2009;284(5):3273-3284. doi: 10.1074/jbc.M806889200. Epub Nov. 14, 2008.
Ward et al., Binding activities of a repertoire of single immunoglobulin variable domains secreted from *Escherichia coli*. Nature. Oct. 12, 1989;341(6242):544-6. doi: 10.1038/341544a0.
Ex Parte Decision on Appeal from the Patent Trial and Appeal Board, United States Patent and Trademark Office. Appeal No. 2024-002920. Nov. 8, 2024. 11 pages.
[No Author Listed], Comparison of pre-existing ADA recognition of sdAbs with S112 vs. S112K vs. S112+A. Submitted in Opposition in Application No. EP 17178990.2. Opposition filed Oct. 25, 2022. Document dated Apr. 12, 2024. 3 pages. D25.
[No Author Listed], Comparison of pre-existing ADA recognition of sdAbs with S112 vs. S112K vs. S112+A. Submitted in Opposition in Application No. EP 17178990.2. Opposition filed Oct. 25, 2022. Document dated Apr. 12, 2024. 4 pages. D24.
[No Author Listed], Comparison of pre-existing ADA recognition of sdAbs with S112 vs. S112K with and without exposed C-termini.

(56) References Cited

OTHER PUBLICATIONS

Submitted in Opposition in Application No. EP 17178990.2. Opposition filed Oct. 25, 2022. Document dated Apr. 12, 2024. 4 pages. D23.

[No Author Listed], Response to Communication Pursuant to Rule 64 EPC dated Aug. 17, 2017. Submitted in Opposition in Application No. EP 17178990.2. Opposition filed Oct. 25, 2022. Document dated Oct. 18, 2017. 9 pages. D9.

[No Author Listed], Summary of Facts and Submissions in Support of Opposition in Application No. EP 15722211.8, filed Oct. 25, 2022. 19 pages. D5.

[No Author Listed], Technical Test Report. Submitted in Opposition in Application No. EP 17178990.2. Opposition filed Oct. 25, 2022. Document dated Sep. 20, 2024. 21 pages. D26.

Boutton, Declaration about the structural conservation of positions 11 and 89 in VHH-based and VH-based ISVDs. Submitted in Opposition in Application No. EP 17178990.2. Opposition filed Oct. 25, 2022. Document dated Mar. 20, 2023. 14 pages. D20.

Gorlani et al., Antibody engineering reveals the important role of J segments in the production efficiency of llama single-domain antibodies in *Saccharomyces cerevisiae*. Protein Eng Des Sel. Jan. 2012;25(1):39-46. doi: 10.1093/protein/gzr057. Epub Dec. 5, 2011.

Wang Tinghua et al., Antibody Theory and Technology. Science Press. Mar. 2005. p. 37. 15 pages.

Coulon et al., Functional characterization of an anti-estradiol antibody by site-directed mutagenesis and molecular modelling: modulation of binding properties and prominent role of the V(L) domain in estradiol recognition. J Mol Recognit. Jan. 2002-Feb. 15(1):6-18. doi: 10.1002/jmr.553.

Muyldermans et al., Sequence and structure of VH domain from naturally occurring camel heavy chain immunoglobulins lacking light chains. Protein Eng. Sep. 1994;7(9):1129-35. doi: 10.1093/protein/7.9.1129.

Noel et al., Analysis of the individual contributions of immunoglobulin heavy and light chains to the binding of antigen using cell transfection and plasmon resonance analysis. J Immunol Methods. Jun. 21, 1996;193(2):177-87. doi: 10.1016/0022-1759(96)00043-9.

Utsumi et al., The Subunits of Purified Rabbit Antibody. Biochemistry. Sep. 1964;3:1329-38. doi: 10.1021/bi00897a024.

Xu et al., Diversity in the CDR3 region of V(H) is sufficient for most antibody specificities. Immunity. Jul. 2000;13(1):37-45. doi: 10.1016/s1074-7613(00)00006-6.

* cited by examiner

Figure 1

| Numbering according to Kabat (VH) | Numbering according to Chotia (VH) | Aho numbering | IMGT |
|---|---|---|---|
| 11 | 11 | 12 | 12 |
| 14 | 14 | 15 | 15 |
| 41 | 41 | 48 | 46 |
| 42 | 42 | 49 | 47 |
| 87 | 87 | 101 | 99 |
| 89 | 89 | 103 | 101 |
| 108 | 108 | 144 | ---- |
| 110 | 110 | 146 | ---- |
| 112 | 112 | 148 | ---- |

Source: http://www.bioc.uzh.ch/plueckthun/antibody/Numbering/NumFrame.html

Figure 2

| | | |
|---|---|---|
| SEQ ID NO:1 | C-terminal end | VTVKS |
| SEQ ID NO:2 | C-terminal end | VTVQS |
| SEQ ID NO:3 | FR4 sequence | WGQGTQVTVKS |
| SEQ ID NO:4 | FR4 sequence | WGKGTLVTVKS |
| SEQ ID NO:5 | FR4 sequence | RGQGTRVTVKS |
| SEQ ID NO:6 | FR4 sequence | WGLGTQVTISS |
| SEQ ID NO:7 | FR4 sequence | GSQGTQVTVKS |
| SEQ ID NO:8 | FR4 sequence | LRGGTQVTVKS |
| SEQ ID NO:9 | FR4 sequence | RGQGTLVTVKS |
| SEQ ID NO:10 | FR4 sequence | RSRGIQVTVKS |
| SEQ ID NO:11 | FR4 sequence | WGKGTQVTVKS |
| SEQ ID NO:12 | FR4 sequence | WGQGTQVTVQS |
| SEQ ID NO:13 | FR4 sequence | WGKGTLVTVQS |
| SEQ ID NO:14 | FR4 sequence | RGQGTRVTVQS |
| SEQ ID NO:15 | FR4 sequence | WGLGTQVTISS |
| SEQ ID NO:16 | FR4 sequence | GSQGTQVTVQS |
| SEQ ID NO:17 | FR4 sequence | LRGGTQVTVQS |
| SEQ ID NO:18 | FR4 sequence | RGQGTLVTVQS |
| SEQ ID NO:19 | FR4 sequence | RSRGIQVTVQS |
| SEQ ID NO:20 | FR4 sequence | WGKGTQVTVQS |
| SEQ ID NO:21 | C-terminal end with C-terminal extension | VTVKS$(X)_n$ |

Figure 2 (continued)

| | | |
|---|---|---|
| SEQ ID NO:22 | C-terminal end with C-terminal extension | VTVQS$(X)_n$ |
| SEQ ID NO:23 | FR4 sequence with C-terminal extension | WGQGTQVTVKS$(X)_n$ |
| SEQ ID NO:24 | FR4 sequence with C-terminal extension | WGKGTLVTVKS$(X)_n$ |
| SEQ ID NO:25 | FR4 sequence with C-terminal extension | RGQGTRVTVKS$(X)_n$ |
| SEQ ID NO:26 | FR4 sequence with C-terminal extension | WGLGTQVTISS$(X)_n$ |
| SEQ ID NO:27 | FR4 sequence with C-terminal extension | GSQGTQVTVKS$(X)_n$ |
| SEQ ID NO:28 | FR4 sequence with C-terminal extension | LRGGTQVTVKS$(X)_n$ |
| SEQ ID NO:29 | FR4 sequence with C-terminal extension | RGQGTLVTVKS$(X)_n$ |
| SEQ ID NO:30 | FR4 sequence with C-terminal extension | RSRGIQVTVKS$(X)_n$ |

Figure 2 (continued)

| | | |
|---|---|---|
| SEQ ID NO:31 | FR4 sequence with C-terminal extension | WGKGTQVTVKS$(X)_n$ |
| SEQ ID NO:32 | FR4 sequence with C-terminal extension | WGQGTQVTVQS$(X)_n$ |
| SEQ ID NO:33 | FR4 sequence with C-terminal extension | WGKGTLVTVQS$(X)_n$ |
| SEQ ID NO:34 | FR4 sequence with C-terminal extension | RGQGTRVTVQS$(X)_n$ |
| SEQ ID NO:35 | FR4 sequence with C-terminal extension | WGLGTQVTISS$(X)_n$ |
| SEQ ID NO:36 | FR4 sequence with C-terminal extension | GSQGTQVTVQS$(X)_n$ |
| SEQ ID NO:37 | FR4 sequence with C-terminal extension | LRGGTQVTVQS$(X)_n$ |
| SEQ ID NO:38 | FR4 sequence with C-terminal extension | RGQGTLVTVQS$(X)_n$ |
| SEQ ID NO:39 | FR4 sequence with C-terminal extension | RSRGIQVTVQS$(X)_n$ |

Figure 2 (continued)

| | | |
|---|---|---|
| SEQ ID NO:40 | FR4 sequence with C-terminal extension | WGKGTQVTVQS$(X)_n$ |
| SEQ ID NO:41 | CDR1 sequence | SFGMS |
| SEQ ID NO:42 | CDR2 sequence | SISGSGSDTLYADSVKG |
| SEQ ID NO:43 | CDR3 sequence | GGSLSR |
| SEQ ID NO:44 | Reference A. | HHHHHHEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| SEQ ID NO:45 | Reference B. SEQ ID NO:37 from WO 12/175741 | HHHHHHEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSA |
| SEQ ID NO:46 | Alb-8 (WO 06/122787) | EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| SEQ ID NO:47 | Alb-8 + 112K | EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVKS |
| SEQ ID NO:48 | Alb-8 + 112K + A | EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVKSA |
| SEQ ID NO:49 | Alb-8 + 112K + AA | EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVKSAA |
| SEQ ID NO:50 | Alb-8 + 112K + AAA | EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVKSAAA |
| SEQ ID NO:51 | Alb-8 + 112K + G | EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVKSG |
| SEQ ID NO:52 | Alb-8 + 112K + GG | EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVKSGG |

Figure 2 (continued)

| | | |
|---|---|---|
| SEQ ID NO:53 | Alb-8 + 112K + GGG | EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVKSGGG |
| SEQ ID NO:54 | Alb-8 + 112Q | EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVQS |
| SEQ ID NO:55 | Alb-8 + 112Q + A | EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVQSA |
| SEQ ID NO:56 | Alb-8 + 112Q + AA | EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVQSAA |
| SEQ ID NO:57 | Alb-8 + 112Q + AAA | EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVQSAAA |
| SEQ ID NO:58 | Alb-8 + 112Q + G | EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVQSG |
| SEQ ID NO:59 | Alb-8 + 112Q + GG | EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVQSGG |
| SEQ ID NO:60 | Alb-8 + 112Q + GGG | EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVQSGGG |
| SEQ ID NO:61 | Alb-23 (WO 12/175400) | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSS |
| SEQ ID NO:62 | Alb-23 + 112K | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVKS |
| SEQ ID NO:63 | Alb-23 + 112K +A | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVKSA |
| SEQ ID NO:64 | Alb-23 + 112K +AA | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVKSAA |
| SEQ ID NO:65 | Alb-23 + 112K +AAA | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVKSAAA |

Figure 2 (continued)

| | | |
|---|---|---|
| SEQ ID NO:66 | Alb-23 + 112K +G | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVKSG |
| SEQ ID NO:67 | Alb-23 + 112K +GG | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVKSGG |
| SEQ ID NO:68 | Alb-23 + 112K +GGG | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVKSGGG |
| SEQ ID NO:69 | Alb-23 + 112Q | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVQS |
| SEQ ID NO:70 | Alb-23 + 112Q +A | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVQSA |
| SEQ ID NO:71 | Alb-23 + 112Q +AA | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVQSAA |
| SEQ ID NO:72 | Alb-23 + 112Q +AAA | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVQSAAA |
| SEQ ID NO:73 | Alb-23 + 112Q +G | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVQSG |
| SEQ ID NO:74 | Alb-23 + 112Q +GG | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVQSGG |
| SEQ ID NO:75 | Alb-23 + 112Q +GGG | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVQSGGG |
| SEQ ID NO:76 | C-terminal end | VTVSS |
| SEQ ID NO:77 | C-terminal end with C-terminal extension | VTVSS(X)$_n$ |
| SEQ ID NO:78 | Serum albumin-binding nanobody with V89T substitution | EVQLVESGGGLVQPGNSLRLSCAASGFTFSSFGMSWVRQAPGKGLEWVSSISGSGSDTLYADSVKGRFTISRDNAKTTLYLQMNSLRPEDTATYYCTIGGSLSRSSQGTLVTVSS |

Figure 2 (continued)

| | | |
|---|---|---|
| SEQ ID NO:79 | Serum albumin-binding nanobody with V89T substitution | EVQLVESGGGLVQPGNSLRLSCAASGFTFSSFGMSWVRQAPGKGLEWVSSISGSGSDTLYADSVKGRFTISRDNAKTTLYLQMNSLRPEDTATYYCTIGGSLSRSSQGTLVTVSSA |
| SEQ ID NO:80 | Serum albumin-binding nanobody with V89T substitution | EVQLVESGGGLVQPGNSLRLSCAASGFTFSSFGMSWVRQAPGKGLEWVSSISGSGSDTLYADSVKGRFTISRDNAKTTLYLQMNSLRPEDTATYYCTIGGSLSRSSQGTLVTVSSAA |
| SEQ ID NO:81 | Serum albumin-binding nanobody with V89T substitution | EVQLVESGGGLVQPGNSLRLSCAASGFTFSSFGMSWVRQAPGKGLEWVSSISGSGSDTLYADSVKGRFTISRDNAKTTLYLQMNSLRPEDTATYYCTIGGSLSRSSQGTLVTVSSAAA |
| SEQ ID NO:82 | Serum albumin-binding nanobody with V89T substitution | EVQLVESGGGLVQPGNSLRLSCAASGFTFSSFGMSWVRQAPGKGLEWVSSISGSGSDTLYADSVKGRFTISRDNAKTTLYLQMNSLRPEDTATYYCTIGGSLSRSSQGTLVTVSSG |
| SEQ ID NO:83 | Serum albumin-binding nanobody with V89T substitution | EVQLVESGGGLVQPGNSLRLSCAASGFTFSSFGMSWVRQAPGKGLEWVSSISGSGSDTLYADSVKGRFTISRDNAKTTLYLQMNSLRPEDTATYYCTIGGSLSRSSQGTLVTVSSGG |
| SEQ ID NO:84 | Serum albumin-binding nanobody with V89T substitution | EVQLVESGGGLVQPGNSLRLSCAASGFTFSSFGMSWVRQAPGKGLEWVSSISGSGSDTLYADSVKGRFTISRDNAKTTLYLQMNSLRPEDTATYYCTIGGSLSRSSQGTLVTVSSGGG |
| SEQ ID NO:85 | Serum albumin-binding nanobody with V89T substitution | EVQLLESGGGLVQPGGSLRLSCAASGFTFRSFGMSWVRQAPGKGPEWVSSISGSGSDTLYADSVKGRFTISRDNSKNTLYLQMNSLRPEDTATYYCTIGGSLSRSSQGTLVTVSS |
| SEQ ID NO:86 | Serum albumin-binding nanobody with V89T substitution | EVQLLESGGGLVQPGGSLRLSCAASGFTFRSFGMSWVRQAPGKGPEWVSSISGSGSDTLYADSVKGRFTISRDNSKNTLYLQMNSLRPEDTATYYCTIGGSLSRSSQGTLVTVSSA |

Figure 2 (continued)

| | | |
|---|---|---|
| SEQ ID NO:87 | Serum albumin-binding nanobody with V89T substitution | EVQLLESGGGLVQPGGSLRLSCAASGFTFRSFGMSWVRQAPGKGPEWVSSISGSGSDTLYADSVKGRFTISRDNSKNTLYLQMNSLRPEDTATYYCTIGGSLSRSSQGTLVTVSSAA |
| SEQ ID NO:88 | Serum albumin-binding nanobody with V89T substitution | EVQLLESGGGLVQPGGSLRLSCAASGFTFRSFGMSWVRQAPGKGPEWVSSISGSGSDTLYADSVKGRFTISRDNSKNTLYLQMNSLRPEDTATYYCTIGGSLSRSSQGTLVTVSSAAA |
| SEQ ID NO:89 | Serum albumin-binding nanobody with V89T substitution | EVQLLESGGGLVQPGGSLRLSCAASGFTFRSFGMSWVRQAPGKGPEWVSSISGSGSDTLYADSVKGRFTISRDNSKNTLYLQMNSLRPEDTATYYCTIGGSLSRSSQGTLVTVSSG |
| SEQ ID NO:90 | Serum albumin-binding nanobody with V89T substitution | EVQLLESGGGLVQPGGSLRLSCAASGFTFRSFGMSWVRQAPGKGPEWVSSISGSGSDTLYADSVKGRFTISRDNSKNTLYLQMNSLRPEDTATYYCTIGGSLSRSSQGTLVTVSSGG |
| SEQ ID NO:91 | Serum albumin-binding nanobody with V89T substitution | EVQLLESGGGLVQPGGSLRLSCAASGFTFRSFGMSWVRQAPGKGPEWVSSISGSGSDTLYADSVKGRFTISRDNSKNTLYLQMNSLRPEDTATYYCTIGGSLSRSSQGTLVTVSSGGG |
| SEQ ID NO:92 | Nanobody A used in Example 6 | EVQLVESGGGLVQPGGSLRLSCAASGRTFNNYAMGWFRQAPGKEREFVAAITRSGVRSGVSAIYGDSVKDRFTISRDNAKNTLYLQMNSLRPEDTAVYYCAASAIGSGALRRFEYDYSGQGTLVTVSS |
| SEQ ID NO:93 | Nanobody B used in Example 6 | EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |
| SEQ ID NO:94 | Nanobody C used in Example 6 | EVQLVESGGGLVQPGGSLRLSCAASRSIGRLDRMGWYRHRPGEPRELVATITGGSSINYGDSVKGRFTISIDNSKNTVYLQMNSLRPEDTAVYYCNFNKYVTSRDTWGQGTLVTVSS |

Figure 2 (continued)

| | | |
|---|---|---|
| SEQ ID NO:95 | C-terminal end | VKVSS |
| SEQ ID NO:96 | C-terminal end | VQVSS |
| SEQ ID NO:97 | C-terminal end | VKVSS(X)n |
| SEQ ID NO:98 | C-terminal end | VQVSS(X)n |
| SEQ ID NO:99 | FR4 sequence | SSQGTLVTVKS |
| SEQ ID NO:100 | FR4 sequence | SSQGTLVTVQS |
| SEQ ID NO:101 | FR4 sequence | SSQGTLVKVSS |
| SEQ ID NO:102 | FR4 sequence | SSQGTLVQVSS |
| SEQ ID NO:103 | FR4 sequence with C-terminal extension | SSQGTLVTVKS(X)n |
| SEQ ID NO:104 | FR4 sequence with C-terminal extension | SSQGTLVTVQS(X)n |
| SEQ ID NO:105 | FR4 sequence with C-terminal extension | SSQGTLVKVSS(X)n |
| SEQ ID NO:106 | FR4 sequence with C-terminal extension | SSQGTLVQVSS(X)n |
| SEQ ID NO:107 | C-terminal sequence | VZVZS |
| SEQ ID NO:108 | C-terminal sequence | VZVZS(X)n |
| SEQ ID NO:109 | Serum albumin-binding nanobody with L11V + V89L substitution | EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSS |

Figure 2 (continued)

| | | |
|---|---|---|
| SEQ ID NO:110 | Serum albumin-binding nanobody with L11V + V89L substitution | EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA |
| SEQ ID NO:111 | Serum albumin-binding nanobody with L11V + V89L substitution | EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSAA |
| SEQ ID NO:112 | Serum albumin-binding nanobody with L11V + V89L substitution | EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSAAA |
| SEQ ID NO:113 | Serum albumin-binding nanobody with L11V + V89L substitution | EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSG |
| SEQ ID NO:114 | Serum albumin-binding nanobody with L11V + V89L substitution | EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGG |
| SEQ ID NO:115 | Serum albumin-binding nanobody with L11V + V89L substitution | EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGG |

Figure 2 (continued)

| | | |
|---|---|---|
| SEQ ID NO:116 | Serum albumin-binding nanobody with L11V + V89L substitution | EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSS |
| SEQ ID NO:117 | Serum albumin-binding nanobody with L11V + V89L substitution | EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSA |
| SEQ ID NO:118 | Serum albumin-binding nanobody with L11V + V89L substitution | EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSAA |
| SEQ ID NO:119 | Serum albumin-binding nanobody with L11V + V89L substitution | EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSAAA |
| SEQ ID NO:120 | Serum albumin-binding nanobody with L11V + V89L substitution | EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSG |
| SEQ ID NO:121 | Serum albumin-binding nanobody with L11V + V89L substitution | EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSGG |

Figure 2 (continued)

| | | |
|---|---|---|
| SEQ ID NO:122 | Serum albumin-binding nanobody with L11V + V89L substitution | EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSGGG |
| SEQ ID NO:123 | Serum albumin-binding nanobody with L11V + V89L + T110K substitution | EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSS |
| SEQ ID NO:124 | Serum albumin-binding nanobody with L11V + V89L + T110K substitution | EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSA |
| SEQ ID NO:125 | Serum albumin-binding nanobody with L11V + V89L + T110K substitution | EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSAA |
| SEQ ID NO:126 | Serum albumin-binding nanobody with L11V + V89L + T110K substitution | EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSAAA |
| SEQ ID NO:127 | Serum albumin-binding nanobody with L11V + V89L + T110K substitution | EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSG |

Figure 2 (continued)

| | | |
|---|---|---|
| SEQ ID NO:128 | Serum albumin-binding nanobody with L11V + V89L + T110K substitution | EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGG |
| SEQ ID NO:129 | Serum albumin-binding nanobody with L11V + V89L + T110K substitution | EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGG |
| SEQ ID NO:130 | Serum albumin-binding nanobody with L11V + V89L + T110K substitution | EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSS |
| SEQ ID NO:131 | Serum albumin-binding nanobody with L11V + V89L + T110K substitution | EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSA |
| SEQ ID NO:132 | Serum albumin-binding nanobody with L11V + V89L + T110K substitution | EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSAA |
| SEQ ID NO:133 | Serum albumin-binding nanobody with L11V + V89L + T110K substitution | EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSAAA |

Figure 2 (continued)

| | | |
|---|---|---|
| SEQ ID NO:134 | Serum albumin-binding nanobody with L11V + V89L + T110K substitution | EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSG |
| SEQ ID NO:135 | Serum albumin-binding nanobody with L11V + V89L + T110K substitution | EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSGG |
| SEQ ID NO:136 | Serum albumin-binding nanobody with L11V + V89L + T110K substitution | EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSGGG |
| **Note:** In the sequences above, whenever $(X)_n$ is present, it represents a C-terminal extension, with n = 1, 2, 3, 4 or 5 (preferably 1, 2 or 3, more preferably 1 or 2, most preferably 1) and each X being independently chosen from suitable amino acids (preferably from naturally occurring amino acid residues, more preferably from the group consisting of A, G, V, L or I, with A and/or G being particularly preferred). | | |
| Note: In the sequences of SEQ ID NO: 107 (VZVZS) and 108 (VZVZS(X)n), each Z is independently K or Q. | | |

Figure 9A

| Clone | SEQ ID NO: | Sequence |
|---|---|---|
| A0194009G09 (reference) | 137 (495)(*) | EVQLVESGGGLVQAGGSLGLSCSASGLLFSRNSAGWYRQAPGKQREFVARIRMGGSINYADTVK GRFTISRDNAKNTVYLQMNSLKPEDTAVYYCSSWRTGFYEYWGQGTLVTVSS |
| A0194009G09 (E1D,L11V,A14P,G19R,M53A,T62S,A74S,K83R,V89L,S94G) | 138 (523) | DVQLVESGGGVVQPGGSLRLSCSASGLLFSRNSAGWYRQAPGKQREFVARIRAGGSINYADSVKG RFTISRDNSKNTVYLQMNSLRPEDTALYYCSGWRTGFYEYWGQGTLVTVSS |
| A0194009G09 (E1D,L11V,A14P,G19R,M53A,T62S,A74S,K83R,V89L,T97E) | 139 (524) | DVQLVESGGGVVQPGGSLRLSCSASGLLFSRNSAGWYRQAPGKQREFVARIRAGGSINYADSVKG RFTISRDNSKNTVYLQMNSLRPEDTALYYCSSWREGFYEYWGQGTLVTVSS |
| A0194009G09 (E1D,L11V,A14P,G19R,M53A,T62S,A74S,K83R,V89L,S94G,T97E) | 140 (525) | DVQLVESGGGVVQPGGSLRLSCSASGLLFSRNSAGWYRQAPGKQREFVARIRAGGSINYADSVKG RFTISRDNSKNTVYLQMNSLRPEDTALYYCSGWREGFYEYWGQGTLVTVSS |
| A0194009G09 (E1D,L11V,A14P,G19R,M53Q,T62S,A74S,K83R,V89L,S94G) | 141 (526) | DVQLVESGGGVVQPGGSLRLSCSASGLLFSRNSAGWYRQAPGKQREFVARIRQGGSINYADSVKG RFTISRDNSKNTVYLQMNSLRPEDTALYYCSGWRTGFYEYWGQGTLVTVSS |

(*) In Figures 9A and 9B, the number between parenthesis refers to the SEQ ID NO by which this sequence is listed in the co-pending US provisional application entitled "Kv1.3 binding immunoglobulins" (filing date: March 16, 2015; assignee: Ablynx N.V.).

Figure 9A (continued)

| Clone | SEQ ID NO: | Sequence |
|---|---|---|
| A0194009G09 (E1D,L11V,A14P,G19R,M53Q,T62S,A74S,K83R,V89L,T97E) | 142 (527) | DVQLVESGGGVVQPGGSLRLSCSASGLLFSRNSAGWYRQAPGKQREFVARIRQGGSINYADSVKG RFTISRDNSKNTVYLQMNSLRPEDTALYYCSSWREGFYEYWGQGTLVTVSS |
| A0194009G09 (E1D,L11V,A14P,G19R,M53Q,T62S,A74S,K83R,V89L,S94G,T97E) | 143 (528) | DVQLVESGGGVVQPGGSLRLSCSASGLLFSRNSAGWYRQAPGKQREFVARIRQGGSINYADSVKG RFTISRDNSKNTVYLQMNSLRPEDTALYYCSGWREGFYEYWGQGTLVTVSS |
| A0194009G09 (E1D,L11V,A14P,G19R,M53Y,T62S,A74S,K83R,V89L,S94G) | 144 (529) | DVQLVESGGGVVQPGGSLRLSCSASGLLFSRNSAGWYRQAPGKQREFVARIRYGGSINYADSVKG RFTISRDNSKNTVYLQMNSLRPEDTALYYCSGWRTGFYEYWGQGTLVTVSS |
| A0194009G09 (E1D,L11V,A14P,G19R,M53Y,T62S,A74S,K83R,V89L,T97E) | 145 (530) | DVQLVESGGGVVQPGGSLRLSCSASGLLFSRNSAGWYRQAPGKQREFVARIRYGGSINYADSVKG RFTISRDNSKNTVYLQMNSLRPEDTALYYCSSWREGFYEYWGQGTLVTVSS |
| A0194009G09 (E1D,L11V,A14P,G19R,M53Y,T62S,A74S,K83R,V89L,S94G,T97E) | 146 (531) | DVQLVESGGGVVQPGGSLRLSCSASGLLFSRNSAGWYRQAPGKQREFVARIRYGGSINYADSVKG RFTISRDNSKNTVYLQMNSLRPEDTALYYCSGWREGFYEYWGQGTLVTVSS |

Figure 9A (continued)

| Clone | SEQ ID NO: | Sequence |
|---|---|---|
| A0194009G09 (L11V,A14P,G19R,M53A,T62S,A74S,K83R,V89L, S94G) | 147 (532) | EVQLVESGGGVVQPGGSLRLSCSASGLLFSRNSAGWYRQAPGKQREFVARIRAGGSINYADSVKG RFTISRDNSKNTVYLQMNSLRPEDTALYYCSGWRTGFYEYWGQGTLVTVSS |
| A0194009G09 (L11V,A14P,G19R,M53A,T62S,A74S,K83R,V89L, T97E) | 148 (533) | EVQLVESGGGVVQPGGSLRLSCSASGLLFSRNSAGWYRQAPGKQREFVARIRAGGSINYADSVKG RFTISRDNSKNTVYLQMNSLRPEDTALYYCSSWREGFYEYWGQGTLVTVSS |
| A0194009G09 (L11V,A14P,G19R,M53A,T62S,A74S,K83R,V89L, S94G,T97E) | 149 (534) | EVQLVESGGGVVQPGGSLRLSCSASGLLFSRNSAGWYRQAPGKQREFVARIRAGGSINYADSVKG RFTISRDNSKNTVYLQMNSLRPEDTALYYCSGWREGFYEYWGQGTLVTVSS |
| A0194009G09 (L11V,A14P,G19R,M53Q,T62S,A74S,K83R,V89L, S94G) | 150 (535) | EVQLVESGGGVVQPGGSLRLSCSASGLLFSRNSAGWYRQAPGKQREFVARIRQGGSINYADSVKG RFTISRDNSKNTVYLQMNSLRPEDTALYYCSGWRTGFYEYWGQGTLVTVSS |
| A0194009G09 (L11V,A14P,G19R,M53Q,T62S,A74S,K83R,V89L, T97E) | 151 (536) | EVQLVESGGGVVQPGGSLRLSCSASGLLFSRNSAGWYRQAPGKQREFVARIRQGGSINYADSVKG RFTISRDNSKNTVYLQMNSLRPEDTALYYCSSWREGFYEYWGQGTLVTVSS |
| A0194009G09 (L11V,A14P,G19R,M53Q,T62S,A74S,K83R,V89L, S94G,T97E) | 152 (537) | EVQLVESGGGVVQPGGSLRLSCSASGLLFSRNSAGWYRQAPGKQREFVARIRQGGSINYADSVKG RFTISRDNSKNTVYLQMNSLRPEDTALYYCSGWREGFYEYWGQGTLVTVSS |

Figure 9A (continued)

| Clone | SEQ ID NO: | Sequence |
|---|---|---|
| A0194009G09 (L11V,A14P,G19R,M53Y,T62S,A74S,K83R,V89L, S94G) | 153 (538) | EVQLVESGGGVVQPGGSLRLSCSASGLLFSRNSAGWYRQAPGKQREFVARIRYGGSINYADSVKGRFTISRDNSKNTVYLQMNSLRPEDTALYYCSGWRTGFYEYWGQGTLVTVSS |
| A0194009G09 (L11V,A14P,G19R,M53Y,T62S,A74S,K83R,V89L, T97E) | 154 (539) | EVQLVESGGGVVQPGGSLRLSCSASGLLFSRNSAGWYRQAPGKQREFVARIRYGGSINYADSVKGRFTISRDNSKNTVYLQMNSLRPEDTALYYCSSWREGFYEYWGQGTLVTVSS |
| A0194009G09 (L11V,A14P,G19R,M53Y,T62S,A74S,K83R,V89L, S94G,T97E) | 155 (540) | EVQLVESGGGVVQPGGSLRLSCSASGLLFSRNSAGWYRQAPGKQREFVARIRYGGSINYADSVKGRFTISRDNSKNTVYLQMNSLRPEDTALYYCSGWREGFYEYWGQGTLVTVSS |

Figure 9B

| Clone | SEQ ID NO: | Sequence |
|---|---|---|
| A0194009G09 (E1D,L11V,A14P,G19R,M53Q,T62S,A74S,K83R,V89L,S94G)-35GS-A0194009G09 (L11V,A14P,G19R,M53Q,T62S,A74S,K83R,V89L,S94G)-35GS-ALB82-A(**) | 156 (514) (*) | DVQLVESGGGVVQPGGSLRLSCSASGLLFSRNSAGWYRQAPGKQREFVARIRQGGSINYADSVKGRFTISRDNSKNTVYLQMNSLRPEDTALYYCSGWRTGFYEYWGQGTLVTVSSGGGGSGGGGSGGGGSGGGGSGGGGSGGGGSGGGGSEVQLVESGGGVVQPGGSLRLSCSASGLLFSRNSAGWYRQAPGKQREFVARIRQGGSINYADSVKGRFTISRDNSKNTVYLQMNSLRPEDTALYYCSGWRTGFYEYWGQGTLVTVSSGGGGSGGGGSGGGGSGGGGSGGGGSGGGGSGGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA |
| A0194009G09 (E1D,L11V,A14P,G19R,M53Q,T62S,A74S,K83R,V89L,T97E)-35GS-A0194009G09 (L11V,A14P,G19R,M53Q,T62S,A74S,K83R,V89L,T97E)-35GS-ALB82-A | 157 (515) | DVQLVESGGGVVQPGGSLRLSCSASGLLFSRNSAGWYRQAPGKQREFVARIRQGGSINYADSVKGRFTISRDNSKNTVYLQMNSLRPEDTALYYCSSWREGFYEYWGQGTLVTVSSGGGGSGGGGSGGGGSGGGGSGGGGSGGGGSGGGGSEVQLVESGGGVVQPGGSLRLSCSASGLLFSRNSAGWYRQAPGKQREFVARIRQGGSINYADSVKGRFTISRDNSKNTVYLQMNSLRPEDTALYYCSSWREGFYEYWGQGTLVTVSSGGGGSGGGGSGGGGSGGGGSGGGGSGGGGSGGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA |

(*) In Figures 9A and 9B, the number between parenthesis refers to the SEQ ID NO by which this sequence is listed in the co-pending US provisional application entitled "Kv1.3 binding immunoglobulins" (filing date: March 16, 2015; assignee: Ablynx N.V.).

(**)"ALB82" refers to the sequence of SEQ ID NO:109

Figure 9B (continued)

| Clone | SEQ ID NO: | Sequence |
| --- | --- | --- |
| A0194009G09 (E1D,L11V,A14P,G19R,M53A,T62S,A74S,K83R,V89L,S94G)-35GS-A0194009G09 (L11V,A14P,G19R,M53A,T62S,A74S,K83R,V89L,S94G)-35GS-ALB82-A | 158 (516) | DVQLVESGGGVVQPGGSLRLSCSASGLLFSRNSAGWYRQAPGKQREFVARIRAGGSINYADSVKGRFTISRDNSKNTVYLQMNSLRPEDTALYYCSGWRTGFYEYWGQGTLVTVSSGGGGSGGGGSGGGGSGGGGSGGGGSGGGGSGGGGSEVQLVESGGGVVQPGGSLRLSCSASGLLFSRNSAGWYRQAPGKQREFVARIRAGGSINYADSVKGRFTISRDNSKNTVYLQMNSLRPEDTALYYCSGWRTGFYEYWGQGTLVTVSSGGGGSGGGGSGGGGSGGGGSGGGGSGGGGSGGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA |
| A0194009G09 (E1D,L11V,A14P,G19R,M53A,T62S,A74S,K83R,V89L,T97E)-35GS-A0194009G09 (L11V,A14P,G19R,M53A,T62S,A74S,K83R,V89L,T97E)-35GS-ALB82-A | 159 (517) | DVQLVESGGGVVQPGGSLRLSCSASGLLFSRNSAGWYRQAPGKQREFVARIRAGGSINYADSVKGRFTISRDNSKNTVYLQMNSLRPEDTALYYCSSWREGFYEYWGQGTLVTVSSGGGGSGGGGSGGGGSGGGGSGGGGSGGGGSGGGGSEVQLVESGGGVVQPGGSLRLSCSASGLLFSRNSAGWYRQAPGKQREFVARIRAGGSINYADSVKGRFTISRDNSKNTVYLQMNSLRPEDTALYYCSSWREGFYEYWGQGTLVTVSSGGGGSGGGGSGGGGSGGGGSGGGGSGGGGSGGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA |
| A0194009G09 (E1D,L11V,A14P,G19R,M53A,T62S,A74S,K83R,V89L,S94G,T97E-35GS-0194009G09 (L11V,A14P,G19R,M53A,T62S,A74S,K83R,V89L,S94G,T97E)-35GS-ALB82-A | 160 (518) | DVQLVESGGGVVQPGGSLRLSCSASGLLFSRNSAGWYRQAPGKQREFVARIRAGGSINYADSVKGRFTISRDNSKNTVYLQMNSLRPEDTALYYCSGWREGFYEYWGQGTLVTVSSGGGGSGGGGSGGGGSGGGGSGGGGSGGGGSGGGGSEVQLVESGGGVVQPGGSLRLSCSASGLLFSRNSAGWYRQAPGKQREFVARIRAGGSINYADSVKGRFTISRDNSKNTVYLQMNSLRPEDTALYYCSGWREGFYEYWGQGTLVTVSSGGGGSGGGGSGGGGSGGGGSGGGGSGGGGSGGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA |

Figure 9B (continued)

| Clone | SEQ ID NO: | Sequence |
|---|---|---|
| A0194009G09 (E1D,L11V,A14P,G19R,M53Y,T62S,A74S,K83R,V89L,S94G)-35GS-A0194009G09 (L11V,A14P,G19R,M53Y,T62S,A74S,K83R,V89L,S94G)-35GS-ALB82-A | 161 (519) | DVQLVESGGGVVQPGGSLRLSCSASGLLFSRNSAGWYRQAPGKQREFVARIRYGGSINYADSVKGRFTISRDNSKNTVYLQMNSLRPEDTALYYCSGWRTGFYEYWGQGTLVTVSSGGGGSGGGGSGGGGSGGGGSGGGGSGGGGSGGGGSEVQLVESGGGVVQPGGSLRLSCSASGLLFSRNSAGWYRQAPGKQREFVARIRYGGSINYADSVKGRFTISRDNSKNTVYLQMNSLRPEDTALYYCSGWRTGFYEYWGQGTLVTVSSGGGGSGGGGSGGGGSGGGGSGGGGSGGGGSGGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA |
| A0194009G09 (E1D,L11V,A14P,G19R,M53Y,T62S,A74S,K83R,V89L,T97E)-35GS-A0194009G09 L11V,A14P,G19R,M53Y,T62S,A74S,K83R,V89L,T97E)-35GS-ALB82-A | 162 (520) | DVQLVESGGGVVQPGGSLRLSCSASGLLFSRNSAGWYRQAPGKQREFVARIRYGGSINYADSVKGRFTISRDNSKNTVYLQMNSLRPEDTALYYCSSWREGFYEYWGQGTLVTVSSGGGGSGGGGSGGGGSGGGGSGGGGSGGGGSGGGGSEVQLVESGGGVVQPGGSLRLSCSASGLLFSRNSAGWYRQAPGKQREFVARIRYGGSINYADSVKGRFTISRDNSKNTVYLQMNSLRPEDTALYYCSSWREGFYEYWGQGTLVTVSSGGGGSGGGGSGGGGSGGGGSGGGGSGGGGSGGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA |
| A0194009G09 (E1D,L11V,A14P,G19R,M53Y,T62S,A74S,K83R,V89L,S94G,T97E)-35GS-0194009G09 (L11V,A14P,G19R,M53Y,T62S,A74S,K83R,V89L,S94G,T97E)-35GS-ALB82-A | 163 (521) | DVQLVESGGGVVQPGGSLRLSCSASGLLFSRNSAGWYRQAPGKQREFVARIRYGGSINYADSVKGRFTISRDNSKNTVYLQMNSLRPEDTALYYCSGWREGFYEYWGQGTLVTVSSGGGGSGGGGSGGGGSGGGGSGGGGSGGGGSGGGGSEVQLVESGGGVVQPGGSLRLSCSASGLLFSRNSAGWYRQAPGKQREFVARIRYGGSINYADSVKGRFTISRDNSKNTVYLQMNSLRPEDTALYYCSGWREGFYEYWGQGTLVTVSSGGGGSGGGGSGGGGSGGGGSGGGGSGGGGSGGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA |

Figure 9B (continued)

| Clone | SEQ ID NO: | Sequence |
|---|---|---|
| A0194009G09 (E1D,L11V,A14P,G19R,M53Q,T62S,A74S,K83R,V89L,S94G,T97E)-35GS-0194009G09 (L11V,A14P,G19R,M53Q,T62S,A74S,K83R,V89L,S94G,T97E)-35GS-ALB82-A | 164 (522) | DVQLVESGGGVVQPGGSLRLSCSASGLLFSRNSAGWYRQAPGKQREFVARIRQGGSINYADSVKGRFTISRDNSKNTVYLQMNSLRPEDTALYYCSGWREGFYEYWGQGTLVTVSSGGGGSGGGGSGGGGSGGGGSGGGGSGGGGSGGGGSEVQLVESGGGVVQPGGSLRLSCSASGLLFSRNSAGWYRQAPGKQREFVARIRQGGSINYADSVKGRFTISRDNSKNTVYLQMNSLRPEDTALYYCSGWREGFYEYWGQGTLVTVSSGGGGSGGGGSGGGGSGGGGSGGGGSGGGGSGGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA |
| A0194009G09(E1D)-35GS-A0194009G09-35GS-ALB8-A (Reference) | 165 (497) | DVQLVESGGGLVQAGGSLGLSCSASGLLFSRNSAGWYRQAPGKQREFVARIRMGGSINYADTVKGRFTISRDNAKNTVYLQMNSLKPEDTAVYYCSSWRTGFYEYWGQGTLVTVSSGGGGSGGGGSGGGGSGGGGSGGGGSGGGGSGGGGSEVQLVESGGGLVQAGGSLGLSCSASGLLFSRNSAGWYRQAPGKQREFVARIRMGGSINYADTVKGRFTISRDNAKNTVYLQMNSLKPEDTAVYYCSSWRTGFYEYWGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSA |

Figure 9C

| Clone | SEQ ID NO: | Sequence |
|---|---|---|
| CDR1 (Kabat) | 166 | RNSAG |
| CDR2 (Kabat) | 167 | RIRMGGSINYADTVKG |
| CDR3 (Kabat) | 168 | WRTGFYEY |
| CDR1 (Abm) | 169 | GLLFSRNSAG |
| CDR2 (Abm) | 170 | RIRMGGSIN |
| CDR3 (Abm) | 171 | WRTGFYEY |

Figure 12A

| SEQ ID | Mutation(s) | Sequence |
|---|---|---|
| 172 | None (reference) | EVQLLESGGGLVQPGGSLRLSCAASGRIFSLPASGNIFNLLTIAWYRQAPGKGRELVATINSGSRTYYADSVKGRFTISRDNSKKTVYLQMNSLRPEDTAVYYCQTSGSGSPNFWGQGTLVTVSS |
| 173 | CDR1 | LPASGNIFNLLTIA |
| 174 | CDR2 | APGKGRELVATINSGSRTYYADSVKG |
| 175 | CDR3 | SGSGSPNF |
| 176 | 89L + 110K | EVQLLESGGGLVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVKVSS |
| 177 | 89L + 110Q | EVQLLESGGGLVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVQVSS |
| 178 | 110K | EVQLLESGGGLVQPGGSLRLSCAASGRIFSLPASGNIFNLLTIAWYRQAPGKGRELVATINSGSRTYYADSVKGRFTISRDNSKKTVYLQMNSLRPEDTAVYYCQTSGSGSPNFWGQGTLVKVSS |
| 179 | 110Q | EVQLLESGGGLVQPGGSLRLSCAASGRIFSLPASGNIFNLLTIAWYRQAPGKGRELVATINSGSRTYYADSVKGRFTISRDNSKKTVYLQMNSLRPEDTAVYYCQTSGSGSPNFWGQGTLVQVSS |
| 180 | 112K | EVQLLESGGGLVQPGGSLRLSCAASGRIFSLPASGNIFNLLTIAWYRQAPGKGRELVATINSGSRTYYADSVKGRFTISRDNSKKTVYLQMNSLRPEDTAVYYCQTSGSGSPNFWGQGTLVTVKS |
| 181 | 112Q | EVQLLESGGGLVQPGGSLRLSCAASGRIFSLPASGNIFNLLTIAWYRQAPGKGRELVATINSGSRTYYADSVKGRFTISRDNSKKTVYLQMNSLRPEDTAVYYCQTSGSGSPNFWGQGTLVTVQS |
| 182 | 89T | EVQLLESGGGLVQPGGSLRLSCAASGRIFSLPASGNIFNLLTIAWYRQAPGKGRELVATINSGSRTYYADSVKGRFTISRDNSKKTVYLQMNSLRPEDTATYYCQTSGSGSPNFWGQGTLVTVSS |
| 183 | 11V + 89L | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVTVSS |
| 184 | 11V + 89L + 110K | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVKVSS |
| 185 | 11V + 89L + 110Q | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVQVSS |
| 186 | 11V + 110K | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTAVYYCQTSGSGSPNFWGQGTLVKVSS |
| 187 | 11V + 110Q | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTAVYYCQTSGSGSPNFWGQGTLVQVSS |
| 188 | 11V + 112K | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTAVYYCQTSGSGSPNFWGQGTLVTVKS |
| 189 | 11V + 112Q | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTAVYYCQTSGSGSPNFWGQGTLVTVQS |

Figure 12B

| SEQ ID | Mutation(s) | Sequence |
|---|---|---|
| 190 | None (reference) | EVQLLESGGGLVQPGGSLRLSCAASGRTLSSYAMGWFRQAPGK GREFVARISQGGTAIYYADSVKGRFTISRDNSKNTLYLQMNSLR PEDTAVYYCAKDPSPYYRGSAYLLSGSYDSWGQGTLVTVSS |
| 191 | CDR1 | SYAMG |
| 192 | CDR2 | RISQGGTAIYYADSVKG |
| 193 | CDR3 | DPSPYYRGSAYLLSGSYDS |
| 194 | 89L + 110K | EVQLLESGGGLVQPGGSLRLSCAASGRTLSSYAMGWFRQAPGK GREFVARISQGGTAIYYADSVKGRFTISRDNSKNTLYLQMNSLR PEDTALYYCAKDPSPYYRGSAYLLSGSYDSWGQGTLVKVSS |
| 195 | 89L + 110Q | EVQLLESGGGLVQPGGSLRLSCAASGRTLSSYAMGWFRQAPGK GREFVARISQGGTAIYYADSVKGRFTISRDNSKNTLYLQMNSLR PEDTALYYCAKDPSPYYRGSAYLLSGSYDSWGQGTLVQVSS |
| 196 | 110K | EVQLLESGGGLVQPGGSLRLSCAASGRTLSSYAMGWFRQAPGK GREFVARISQGGTAIYYADSVKGRFTISRDNSKNTLYLQMNSLR PEDTAVYYCAKDPSPYYRGSAYLLSGSYDSWGQGTLVKVSS |
| 197 | 110Q | EVQLLESGGGLVQPGGSLRLSCAASGRTLSSYAMGWFRQAPGK GREFVARISQGGTAIYYADSVKGRFTISRDNSKNTLYLQMNSLR PEDTAVYYCAKDPSPYYRGSAYLLSGSYDSWGQGTLVQVSS |
| 198 | 112K | EVQLLESGGGLVQPGGSLRLSCAASGRTLSSYAMGWFRQAPGK GREFVARISQGGTAIYYADSVKGRFTISRDNSKNTLYLQMNSLR PEDTAVYYCAKDPSPYYRGSAYLLSGSYDSWGQGTLVTVKS |
| 199 | 112Q | EVQLLESGGGLVQPGGSLRLSCAASGRTLSSYAMGWFRQAPGK GREFVARISQGGTAIYYADSVKGRFTISRDNSKNTLYLQMNSLR PEDTAVYYCAKDPSPYYRGSAYLLSGSYDSWGQGTLVTVQS |
| 200 | 89T | EVQLLESGGGLVQPGGSLRLSCAASGRTLSSYAMGWFRQAPGK GREFVARISQGGTAIYYADSVKGRFTISRDNSKNTLYLQMNSLR PEDTATYYCAKDPSPYYRGSAYLLSGSYDSWGQGTLVTVSS |
| 201 | 11V + 89L | EVQLLESGGGVVQPGGSLRLSCAASGRTLSSYAMGWFRQAPGK GREFVARISQGGTAIYYADSVKGRFTISRDNSKNTLYLQMNSLR PEDTALYYCAKDPSPYYRGSAYLLSGSYDSWGQGTLVTVSS |
| 202 | 11V + 89L + 110K | EVQLLESGGGVVQPGGSLRLSCAASGRTLSSYAMGWFRQAPGK GREFVARISQGGTAIYYADSVKGRFTISRDNSKNTLYLQMNSLR PEDTALYYCAKDPSPYYRGSAYLLSGSYDSWGQGTLVKVSS |
| 203 | 11V + 89L + 110Q | EVQLLESGGGVVQPGGSLRLSCAASGRTLSSYAMGWFRQAPGK GREFVARISQGGTAIYYADSVKGRFTISRDNSKNTLYLQMNSLR PEDTALYYCAKDPSPYYRGSAYLLSGSYDSWGQGTLVQVSS |
| 204 | 11V + 110K | EVQLLESGGGVVQPGGSLRLSCAASGRTLSSYAMGWFRQAPGK GREFVARISQGGTAIYYADSVKGRFTISRDNSKNTLYLQMNSLR PEDTAVYYCAKDPSPYYRGSAYLLSGSYDSWGQGTLVKVSS |

Figure 12B (Continued)

| SEQ ID | Mutation(s) | Sequence |
|---|---|---|
| 205 | 11V + 110Q | EVQLLESGGGVVQPGGSLRLSCAASGRTLSSYAMGWFRQAPGKGREFVARISQGGTAIYYADSVKGRFTISRDNSKNTLYLQMNSLRPEDTAVYYCAKDPSPYYRGSAYLLSGSYDSWGQGTLVQVSS |
| 206 | 11V + 112K | EVQLLESGGGVVQPGGSLRLSCAASGRTLSSYAMGWFRQAPGKGREFVARISQGGTAIYYADSVKGRFTISRDNSKNTLYLQMNSLRPEDTAVYYCAKDPSPYYRGSAYLLSGSYDSWGQGTLVTVKS |
| 207 | 11V + 112Q | EVQLLESGGGVVQPGGSLRLSCAASGRTLSSYAMGWFRQAPGKGREFVARISQGGTAIYYADSVKGRFTISRDNSKNTLYLQMNSLRPEDTAVYYCAKDPSPYYRGSAYLLSGSYDSWGQGTLVTVQS |

Figure 13

| SEQ ID | Mutation(s) | Sequence |
|---|---|---|
| 208 | None (reference) | EVQLVESGGGLVQPGGSLRLSCAASRSIGRLDRMGWYRHRPGE PRELVATITGGSSINYGDSVKGRFTISIDNSKNTVYLQMNSLRPE DTAVYYCNFNKYVTSRDTWGQGTLVTVSS |
| 209 | CDR1 | LDRMG |
| 210 | CDR2 | TITGGSSINYGDSVKG |
| 211 | CDR3 | NKYVTSRDT |
| 212 | 89L + 110K | EVQLVESGGGLVQPGGSLRLSCAASRSIGRLDRMGWYRHRPGE PRELVATITGGSSINYGDSVKGRFTISIDNSKNTVYLQMNSLRPE DTALYYCNFNKYVTSRDTWGQGTLVKVSS |
| 213 | 89L + 110Q | EVQLVESGGGLVQPGGSLRLSCAASRSIGRLDRMGWYRHRPGE PRELVATITGGSSINYGDSVKGRFTISIDNSKNTVYLQMNSLRPE DTALYYCNFNKYVTSRDTWGQGTLVQVSS |
| 214 | 110K | EVQLVESGGGLVQPGGSLRLSCAASRSIGRLDRMGWYRHRPGE PRELVATITGGSSINYGDSVKGRFTISIDNSKNTVYLQMNSLRPE DTAVYYCNFNKYVTSRDTWGQGTLVKVSS |
| 215 | 110Q | EVQLVESGGGLVQPGGSLRLSCAASRSIGRLDRMGWYRHRPGE PRELVATITGGSSINYGDSVKGRFTISIDNSKNTVYLQMNSLRPE DTAVYYCNFNKYVTSRDTWGQGTLVQVSS |
| 216 | 112K | EVQLVESGGGLVQPGGSLRLSCAASRSIGRLDRMGWYRHRPGE PRELVATITGGSSINYGDSVKGRFTISIDNSKNTVYLQMNSLRPE DTAVYYCNFNKYVTSRDTWGQGTLVTVKS |
| 217 | 112Q | EVQLVESGGGLVQPGGSLRLSCAASRSIGRLDRMGWYRHRPGE PRELVATITGGSSINYGDSVKGRFTISIDNSKNTVYLQMNSLRPE DTAVYYCNFNKYVTSRDTWGQGTLVTVQS |
| 218 | 89T | EVQLVESGGGLVQPGGSLRLSCAASRSIGRLDRMGWYRHRPGE PRELVATITGGSSINYGDSVKGRFTISIDNSKNTVYLQMNSLRPE DTATYYCNFNKYVTSRDTWGQGTLVTVSS |
| 219 | 11V + 89L | EVQLVESGGGVVQPGGSLRLSCAASRSIGRLDRMGWYRHRPGE PRELVATITGGSSINYGDSVKGRFTISIDNSKNTVYLQMNSLRPE DTALYYCNFNKYVTSRDTWGQGTLVTVSS |
| 220 | 11V + 89L + 110K | EVQLVESGGGVVQPGGSLRLSCAASRSIGRLDRMGWYRHRPGE PRELVATITGGSSINYGDSVKGRFTISIDNSKNTVYLQMNSLRPE DTALYYCNFNKYVTSRDTWGQGTLVKVSS |
| 221 | 11V + 89L + 110Q | EVQLVESGGGVVQPGGSLRLSCAASRSIGRLDRMGWYRHRPGE PRELVATITGGSSINYGDSVKGRFTISIDNSKNTVYLQMNSLRPE DTALYYCNFNKYVTSRDTWGQGTLVQVSS |
| 222 | 11V + 110K | EVQLVESGGGVVQPGGSLRLSCAASRSIGRLDRMGWYRHRPGE PRELVATITGGSSINYGDSVKGRFTISIDNSKNTVYLQMNSLRPE DTAVYYCNFNKYVTSRDTWGQGTLVKVSS |

Figure 13 (Continued)

| SEQ ID | Mutation(s) | Sequence |
|---|---|---|
| 223 | 11V + 110Q | EVQLVESGGGVVQPGGSLRLSCAASRSIGRLDRMGWYRHRPGE PRELVATITGGSSINYGDSVKGRFTISIDNSKNTVYLQMNSLRPE DTAVYYCNFNKYVTSRDTWGQGTLVQVSS |
| 224 | 11V + 112K | EVQLVESGGGVVQPGGSLRLSCAASRSIGRLDRMGWYRHRPGE PRELVATITGGSSINYGDSVKGRFTISIDNSKNTVYLQMNSLRPE DTAVYYCNFNKYVTSRDTWGQGTLVTVKS |
| 225 | 11V + 112Q | EVQLVESGGGVVQPGGSLRLSCAASRSIGRLDRMGWYRHRPGE PRELVATITGGSSINYGDSVKGRFTISIDNSKNTVYLQMNSLRPE DTAVYYCNFNKYVTSRDTWGQGTLVTVQS |

Figure 14

| SEQ ID | Mutation(s) | Sequence |
|---|---|---|
| 226 | None (reference) | DVQLLESGGGLVQPGGSLRLSCAASGFTFGNYDMAWVRQAPGKRPEWVSSIDTGGDITHYADSVKGRFTISRDNAKNTLYLQMNSLRPEDTAVYWCATDEEYALGPNEFDYYGQGTLVTVSS |
| 227 | CDR1 | NYDMA |
| 228 | CDR2 | SIDTGGDITHYADSVKG |
| 229 | CDR3 | DEEYALGPNEFDY |
| 230 | 89L + 110K | DVQLLESGGGLVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVKVSS |
| 231 | 89L + 110Q | DVQLLESGGGLVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVQVSS |
| 232 | 110K | DVQLLESGGGLVQPGGSLRLSCAASGFTFGNYDMAWVRQAPGKRPEWVSSIDTGGDITHYADSVKGRFTISRDNAKNTLYLQMNSLRPEDTAVYWCATDEEYALGPNEFDYYGQGTLVKVSS |
| 233 | 110Q | DVQLLESGGGLVQPGGSLRLSCAASGFTFGNYDMAWVRQAPGKRPEWVSSIDTGGDITHYADSVKGRFTISRDNAKNTLYLQMNSLRPEDTAVYWCATDEEYALGPNEFDYYGQGTLVQVSS |
| 234 | 112K | DVQLLESGGGLVQPGGSLRLSCAASGFTFGNYDMAWVRQAPGKRPEWVSSIDTGGDITHYADSVKGRFTISRDNAKNTLYLQMNSLRPEDTAVYWCATDEEYALGPNEFDYYGQGTLVTVKS |
| 235 | 112Q | DVQLLESGGGLVQPGGSLRLSCAASGFTFGNYDMAWVRQAPGKRPEWVSSIDTGGDITHYADSVKGRFTISRDNAKNTLYLQMNSLRPEDTAVYWCATDEEYALGPNEFDYYGQGTLVTVQS |
| 236 | 89T | DVQLLESGGGLVQPGGSLRLSCAASGFTFGNYDMAWVRQAPGKRPEWVSSIDTGGDITHYADSVKGRFTISRDNAKNTLYLQMNSLRPEDTATYWCATDEEYALGPNEFDYYGQGTLVTVSS |
| 237 | 11V + 89L | DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVTVSS |
| 238 | 11V + 89L + 110K | DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVKVSS |
| 239 | 11V + 89L + 110Q | DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVQVSS |

Figure 14 (continued)

| SEQ ID | Mutation(s) | Sequence |
|---|---|---|
| 240 | 11V + 110K | DVQLLESGGGVVQPGGSLRLSCAASGFTFGNYDMAWVRQAPGKRPEWVSSIDTGGDITHYADSVKGRFTISRDNAKNTLYLQMNSLRPEDTAVYWCATDEEYALGPNEFDYYGQGTLVKVSS |
| 241 | 11V + 110Q | DVQLLESGGGVVQPGGSLRLSCAASGFTFGNYDMAWVRQAPGKRPEWVSSIDTGGDITHYADSVKGRFTISRDNAKNTLYLQMNSLRPEDTAVYWCATDEEYALGPNEFDYYGQGTLVQVSS |
| 242 | 11V + 112K | DVQLLESGGGVVQPGGSLRLSCAASGFTFGNYDMAWVRQAPGKRPEWVSSIDTGGDITHYADSVKGRFTISRDNAKNTLYLQMNSLRPEDTAVYWCATDEEYALGPNEFDYYGQGTLVTVKS |
| 243 | 11V + 112Q | DVQLLESGGGVVQPGGSLRLSCAASGFTFGNYDMAWVRQAPGKRPEWVSSIDTGGDITHYADSVKGRFTISRDNAKNTLYLQMNSLRPEDTAVYWCATDEEYALGPNEFDYYGQGTLVTVQS |

Figure 15A

| SEQ ID | Mutation(s) | Sequence |
|---|---|---|
| 244 | None (reference) | EVQLVESGGGLVQPGGSLRLSCAASGFTFSSYAMSWVRQAPGKGLEWVSGIKSSGDSTRYAGSVKGRFTISRDNAKNTLYLQMNSLRPEDTAVYYCAKSRVSRTGLYTYDNRGQGTLVTVSS |
| 245 | CDR1 | SYAMS |
| 246 | CDR2 | GIKSSGDSTRYAGSVKG |
| 247 | CDR3 | SRVSRTGLYTYDN |
| 248 | 89L + 110K | EVQLVESGGGLVQPGGSLRLSCAASGFTFSSYAMSWVRQAPGKGLEWVSGIKSSGDSTRYAGSVKGRFTISRDNAKNTLYLQMNSLRPEDTALYYCAKSRVSRTGLYTYDNRGQGTLVKVSS |
| 249 | 89L + 110Q | EVQLVESGGGLVQPGGSLRLSCAASGFTFSSYAMSWVRQAPGKGLEWVSGIKSSGDSTRYAGSVKGRFTISRDNAKNTLYLQMNSLRPEDTALYYCAKSRVSRTGLYTYDNRGQGTLVQVSS |
| 250 | 110K | EVQLVESGGGLVQPGGSLRLSCAASGFTFSSYAMSWVRQAPGKGLEWVSGIKSSGDSTRYAGSVKGRFTISRDNAKNTLYLQMNSLRPEDTAVYYCAKSRVSRTGLYTYDNRGQGTLVKVSS |
| 251 | 110Q | EVQLVESGGGLVQPGGSLRLSCAASGFTFSSYAMSWVRQAPGKGLEWVSGIKSSGDSTRYAGSVKGRFTISRDNAKNTLYLQMNSLRPEDTAVYYCAKSRVSRTGLYTYDNRGQGTLVQVSS |
| 252 | 112K | EVQLVESGGGLVQPGGSLRLSCAASGFTFSSYAMSWVRQAPGKGLEWVSGIKSSGDSTRYAGSVKGRFTISRDNAKNTLYLQMNSLRPEDTAVYYCAKSRVSRTGLYTYDNRGQGTLVTVKS |
| 253 | 112Q | EVQLVESGGGLVQPGGSLRLSCAASGFTFSSYAMSWVRQAPGKGLEWVSGIKSSGDSTRYAGSVKGRFTISRDNAKNTLYLQMNSLRPEDTAVYYCAKSRVSRTGLYTYDNRGQGTLVTVQS |
| 254 | 89T | EVQLVESGGGLVQPGGSLRLSCAASGFTFSSYAMSWVRQAPGKGLEWVSGIKSSGDSTRYAGSVKGRFTISRDNAKNTLYLQMNSLRPEDTATYYCAKSRVSRTGLYTYDNRGQGTLVTVSS |
| 255 | 11V + 89L | EVQLVESGGGVVQPGGSLRLSCAASGFTFSSYAMSWVRQAPGKGLEWVSGIKSSGDSTRYAGSVKGRFTISRDNAKNTLYLQMNSLRPEDTALYYCAKSRVSRTGLYTYDNRGQGTLVTVSS |
| 256 | 11V + 89L + 110K | EVQLVESGGGVVQPGGSLRLSCAASGFTFSSYAMSWVRQAPGKGLEWVSGIKSSGDSTRYAGSVKGRFTISRDNAKNTLYLQMNSLRPEDTALYYCAKSRVSRTGLYTYDNRGQGTLVKVSS |
| 257 | 11V + 89L + 110Q | EVQLVESGGGVVQPGGSLRLSCAASGFTFSSYAMSWVRQAPGKGLEWVSGIKSSGDSTRYAGSVKGRFTISRDNAKNTLYLQMNSLRPEDTALYYCAKSRVSRTGLYTYDNRGQGTLVQVSS |

Figure 15A (Continued)

| SEQ ID | Mutation(s) | Sequence |
|---|---|---|
| 258 | 11V + 110K | EVQLVESGGGVVQPGGSLRLSCAASGFTFSSYAMSWVRQAPGK GLEWVSGIKSSGDSTRYAGSVKGRFTISRDNAKNTLYLQMNSLR PEDTAVYYCAKSRVSRTGLYTYDNRGQGTLVKVSS |
| 259 | 11V + 110Q | EVQLVESGGGVVQPGGSLRLSCAASGFTFSSYAMSWVRQAPGK GLEWVSGIKSSGDSTRYAGSVKGRFTISRDNAKNTLYLQMNSLR PEDTAVYYCAKSRVSRTGLYTYDNRGQGTLVQVSS |
| 260 | 11V + 112K | EVQLVESGGGVVQPGGSLRLSCAASGFTFSSYAMSWVRQAPGK GLEWVSGIKSSGDSTRYAGSVKGRFTISRDNAKNTLYLQMNSLR PEDTAVYYCAKSRVSRTGLYTYDNRGQGTLVTVKS |
| 261 | 11V + 112Q | EVQLVESGGGVVQPGGSLRLSCAASGFTFSSYAMSWVRQAPGK GLEWVSGIKSSGDSTRYAGSVKGRFTISRDNAKNTLYLQMNSLR PEDTAVYYCAKSRVSRTGLYTYDNRGQGTLVTVQS |

Figure 15B

| SEQ ID | Mutation(s) | Sequence |
|---|---|---|
| 262 | None (reference) | EVQLVESGGGLVQPGGSLRLSCAASGRTFNNYAMGWFRQAPG KEREFVAAITRSGVRSGVSAIYGDSVKDRFTISRDNAKNTLYLQ MNSLRPEDTAVYYCAASAIGSGALRRFEYDYSGQGTLVTVSS |
| 263 | CDR1 | NYAMG |
| 264 | CDR2 | AITRSGVRSGVSAIYGDSVKD |
| 265 | CDR3 | SAIGSGALRRFEYDY |
| 266 | 89L + 110K | EVQLVESGGGLVQPGGSLRLSCAASGRTFNNYAMGWFRQAPG KEREFVAAITRSGVRSGVSAIYGDSVKDRFTISRDNAKNTLYLQ MNSLRPEDTALYYCAASAIGSGALRRFEYDYSGQGTLVKVSS |
| 267 | 89L + 110Q | EVQLVESGGGLVQPGGSLRLSCAASGRTFNNYAMGWFRQAPG KEREFVAAITRSGVRSGVSAIYGDSVKDRFTISRDNAKNTLYLQ MNSLRPEDTALYYCAASAIGSGALRRFEYDYSGQGTLVQVSS |
| 268 | 110K | EVQLVESGGGLVQPGGSLRLSCAASGRTFNNYAMGWFRQAPG KEREFVAAITRSGVRSGVSAIYGDSVKDRFTISRDNAKNTLYLQ MNSLRPEDTAVYYCAASAIGSGALRRFEYDYSGQGTLVKVSS |
| 269 | 110Q | EVQLVESGGGLVQPGGSLRLSCAASGRTFNNYAMGWFRQAPG KEREFVAAITRSGVRSGVSAIYGDSVKDRFTISRDNAKNTLYLQ MNSLRPEDTAVYYCAASAIGSGALRRFEYDYSGQGTLVQVSS |
| 270 | 112K | EVQLVESGGGLVQPGGSLRLSCAASGRTFNNYAMGWFRQAPG KEREFVAAITRSGVRSGVSAIYGDSVKDRFTISRDNAKNTLYLQ MNSLRPEDTAVYYCAASAIGSGALRRFEYDYSGQGTLVTVKS |
| 271 | 112Q | EVQLVESGGGLVQPGGSLRLSCAASGRTFNNYAMGWFRQAPG KEREFVAAITRSGVRSGVSAIYGDSVKDRFTISRDNAKNTLYLQ MNSLRPEDTAVYYCAASAIGSGALRRFEYDYSGQGTLVTVQS |
| 272 | 89T | EVQLVESGGGLVQPGGSLRLSCAASGRTFNNYAMGWFRQAPG KEREFVAAITRSGVRSGVSAIYGDSVKDRFTISRDNAKNTLYLQ MNSLRPEDTATYYCAASAIGSGALRRFEYDYSGQGTLVTVSS |
| 273 | 11V + 89L | EVQLVESGGGVVQPGGSLRLSCAASGRTFNNYAMGWFRQAPG KEREFVAAITRSGVRSGVSAIYGDSVKDRFTISRDNAKNTLYLQ MNSLRPEDTALYYCAASAIGSGALRRFEYDYSGQGTLVTVSS |
| 274 | 11V + 89L + 110K | EVQLVESGGGVVQPGGSLRLSCAASGRTFNNYAMGWFRQAPG KEREFVAAITRSGVRSGVSAIYGDSVKDRFTISRDNAKNTLYLQ MNSLRPEDTALYYCAASAIGSGALRRFEYDYSGQGTLVKVSS |
| 275 | 11V + 89L + 110Q | EVQLVESGGGVVQPGGSLRLSCAASGRTFNNYAMGWFRQAPG KEREFVAAITRSGVRSGVSAIYGDSVKDRFTISRDNAKNTLYLQ MNSLRPEDTALYYCAASAIGSGALRRFEYDYSGQGTLVQVSS |

Figure 15B (Continued)

| SEQ ID | Mutation(s) | Sequence |
|---|---|---|
| 276 | 11V + 110K | EVQLVESGGGVVQPGGSLRLSCAASGRTFNNYAMGWFRQAPG KEREFVAAITRSGVRSGVSAIYGDSVKDRFTISRDNAKNTLYLQ MNSLRPEDTAVYYCAASAIGSGALRRFEYDYSGQGTLVKVSS |
| 277 | 11V + 110Q | EVQLVESGGGVVQPGGSLRLSCAASGRTFNNYAMGWFRQAPG KEREFVAAITRSGVRSGVSAIYGDSVKDRFTISRDNAKNTLYLQ MNSLRPEDTAVYYCAASAIGSGALRRFEYDYSGQGTLVQVSS |
| 278 | 11V + 112K | EVQLVESGGGVVQPGGSLRLSCAASGRTFNNYAMGWFRQAPG KEREFVAAITRSGVRSGVSAIYGDSVKDRFTISRDNAKNTLYLQ MNSLRPEDTAVYYCAASAIGSGALRRFEYDYSGQGTLVTVKS |
| 279 | 11V + 112Q | EVQLVESGGGVVQPGGSLRLSCAASGRTFNNYAMGWFRQAPG KEREFVAAITRSGVRSGVSAIYGDSVKDRFTISRDNAKNTLYLQ MNSLRPEDTAVYYCAASAIGSGALRRFEYDYSGQGTLVTVQS |

Figure 16A

| SEQ ID | Mutation(s) | Sequence |
|---|---|---|
| 280 | None (reference) | DVQLVESGGGLVQPGGSLRLSCAASGSIGGLNAMAWYRQAPG KERELVAGIFGVGSTRYADSVKGRFTISRDNSKNTVYLQMNSLR PEDTAVYYCRMSSVTRGSSDYWGQGTLVTVSS |
| 281 | CDR1 | LNAMA |
| 282 | CDR2 | GIFGVGSTRYADSVKG |
| 283 | CDR3 | SSVTRGSSDY |
| 284 | 89L + 110K | DVQLVESGGGLVQPGGSLRLSCAASGSIGGLNAMAWYRQAPG KERELVAGIFGVGSTRYADSVKGRFTISRDNSKNTVYLQMNSLR PEDTALYYCRMSSVTRGSSDYWGQGTLVKVSS |
| 285 | 89L + 110Q | DVQLVESGGGLVQPGGSLRLSCAASGSIGGLNAMAWYRQAPG KERELVAGIFGVGSTRYADSVKGRFTISRDNSKNTVYLQMNSLR PEDTALYYCRMSSVTRGSSDYWGQGTLVQVSS |
| 286 | 110K | DVQLVESGGGLVQPGGSLRLSCAASGSIGGLNAMAWYRQAPG KERELVAGIFGVGSTRYADSVKGRFTISRDNSKNTVYLQMNSLR PEDTAVYYCRMSSVTRGSSDYWGQGTLVKVSS |
| 287 | 110Q | DVQLVESGGGLVQPGGSLRLSCAASGSIGGLNAMAWYRQAPG KERELVAGIFGVGSTRYADSVKGRFTISRDNSKNTVYLQMNSLR PEDTAVYYCRMSSVTRGSSDYWGQGTLVQVSS |
| 288 | 112K | DVQLVESGGGLVQPGGSLRLSCAASGSIGGLNAMAWYRQAPG KERELVAGIFGVGSTRYADSVKGRFTISRDNSKNTVYLQMNSLR PEDTAVYYCRMSSVTRGSSDYWGQGTLVTVKS |
| 289 | 112Q | DVQLVESGGGLVQPGGSLRLSCAASGSIGGLNAMAWYRQAPG KERELVAGIFGVGSTRYADSVKGRFTISRDNSKNTVYLQMNSLR PEDTAVYYCRMSSVTRGSSDYWGQGTLVTVQS |
| 290 | 89T | DVQLVESGGGLVQPGGSLRLSCAASGSIGGLNAMAWYRQAPG KERELVAGIFGVGSTRYADSVKGRFTISRDNSKNTVYLQMNSLR PEDTATYYCRMSSVTRGSSDYWGQGTLVTVSS |
| 291 | 11V + 89L | DVQLVESGGGVVQPGGSLRLSCAASGSIGGLNAMAWYRQAPG KERELVAGIFGVGSTRYADSVKGRFTISRDNSKNTVYLQMNSLR PEDTALYYCRMSSVTRGSSDYWGQGTLVTVSS |
| 292 | 11V + 89L + 110K | DVQLVESGGGVVQPGGSLRLSCAASGSIGGLNAMAWYRQAPG KERELVAGIFGVGSTRYADSVKGRFTISRDNSKNTVYLQMNSLR PEDTALYYCRMSSVTRGSSDYWGQGTLVKVSS |
| 293 | 11V + 89L + 110Q | DVQLVESGGGVVQPGGSLRLSCAASGSIGGLNAMAWYRQAPG KERELVAGIFGVGSTRYADSVKGRFTISRDNSKNTVYLQMNSLR PEDTALYYCRMSSVTRGSSDYWGQGTLVQVSS |

Figure 16A (continued)

| SEQ ID | Mutation(s) | Sequence |
|---|---|---|
| 294 | 11V + 110K | DVQLVESGGGVVQPGGSLRLSCAASGSIGGLNAMAWYRQAPG KERELVAGIFGVGSTRYADSVKGRFTISRDNSKNTVYLQMNSLR PEDTAVYYCRMSSVTRGSSDYWGQGTLVKVSS |
| 295 | 11V + 110Q | DVQLVESGGGVVQPGGSLRLSCAASGSIGGLNAMAWYRQAPG KERELVAGIFGVGSTRYADSVKGRFTISRDNSKNTVYLQMNSLR PEDTAVYYCRMSSVTRGSSDYWGQGTLVQVSS |
| 296 | 11V + 112K | DVQLVESGGGVVQPGGSLRLSCAASGSIGGLNAMAWYRQAPG KERELVAGIFGVGSTRYADSVKGRFTISRDNSKNTVYLQMNSLR PEDTAVYYCRMSSVTRGSSDYWGQGTLVTVKS |
| 297 | 11V + 112Q | DVQLVESGGGVVQPGGSLRLSCAASGSIGGLNAMAWYRQAPG KERELVAGIFGVGSTRYADSVKGRFTISRDNSKNTVYLQMNSLR PEDTAVYYCRMSSVTRGSSDYWGQGTLVTVQS |

Figure 16B

| SEQ ID | Mutation(s) | Sequence |
|---|---|---|
| 298 | None (reference) | EVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVSS |
| 299 | CDR1 | LNAMG |
| 300 | CDR2 | AIDWSEGNKDYADSVKG |
| 301 | CDR3 | DTPPWGPLIYIESYDS |
| 302 | 89L + 110K | EVQLVESGGGLVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVKVSS |
| 303 | 89L + 110Q | EVQLVESGGGLVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVQVSS |
| 304 | 110K | EVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVKVSS |
| 305 | 110Q | EVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVQVSS |
| 306 | 112K | EVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVKS |
| 307 | 112Q | EVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVQS |
| 308 | 89T | EVQLVESGGGLVQPGGSLRLSCAASGRTYYLNAMGWFRQAPGKEREFVAAIDWSEGNKDYADSVKGRFTISRDNSKNTVYLQMNSLRPEDTATYYCAADTPPWGPLIYIESYDSWGQGTLVTVSS |
| 309 | 11V + 89L | EVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVTVSS |
| 310 | 11V + 89L + 110K | EVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVKVSS |
| 311 | 11V + 89L + 110Q | EVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVQVSS |

Figure 16B (continued)

| SEQ ID | Mutation(s) | Sequence |
|---|---|---|
| 312 | 11V + 110K | EVQLVESGGGVVQPGGSLRLSCAASGRTYYLNAMGWFRQAPG KEREFVAAIDWSEGNKDYADSVKGRFTISRDNSKNTVYLQMNS LRPEDTAVYYCAADTPPWGPLIYIESYDSWGQGTLVKVSS |
| 313 | 11V + 110Q | EVQLVESGGGVVQPGGSLRLSCAASGRTYYLNAMGWFRQAPG KEREFVAAIDWSEGNKDYADSVKGRFTISRDNSKNTVYLQMNS LRPEDTAVYYCAADTPPWGPLIYIESYDSWGQGTLVQVSS |
| 314 | 11V + 112K | EVQLVESGGGVVQPGGSLRLSCAASGRTYYLNAMGWFRQAPG KEREFVAAIDWSEGNKDYADSVKGRFTISRDNSKNTVYLQMNS LRPEDTAVYYCAADTPPWGPLIYIESYDSWGQGTLVTVKS |
| 315 | 11V + 112Q | EVQLVESGGGVVQPGGSLRLSCAASGRTYYLNAMGWFRQAPG KEREFVAAIDWSEGNKDYADSVKGRFTISRDNSKNTVYLQMNS LRPEDTAVYYCAADTPPWGPLIYIESYDSWGQGTLVTVQS |

Figure 17A

| SEQ ID | Mutation(s) | Sequence |
|---|---|---|
| 316 | None (reference) | EVQLVESGGGLVQPGGSLRLSCAASGFTFSDYWMYWVRQAPG KGLEWVSEINTNGLITKYPDSVKGRFTISRDNAKNTLYLQMNSL RPEDTAVYYCARSPSGFNRGQGTLVTVSS |
| 317 | CDR1 | DYWMY |
| 318 | CDR2 | EINTNGLITKYPDSVKG |
| 319 | CDR3 | SPSGFN |
| 320 | 89L + 110K | EVQLVESGGGLVQPGGSLRLSCAASGFTFSDYWMYWVRQAPG KGLEWVSEINTNGLITKYPDSVKGRFTISRDNAKNTLYLQMNSL RPEDTALYYCARSPSGFNRGQGTLVKVSS |
| 321 | 89L + 110Q | EVQLVESGGGLVQPGGSLRLSCAASGFTFSDYWMYWVRQAPG KGLEWVSEINTNGLITKYPDSVKGRFTISRDNAKNTLYLQMNSL RPEDTALYYCARSPSGFNRGQGTLVQVSS |
| 322 | 110K | EVQLVESGGGLVQPGGSLRLSCAASGFTFSDYWMYWVRQAPG KGLEWVSEINTNGLITKYPDSVKGRFTISRDNAKNTLYLQMNSL RPEDTAVYYCARSPSGFNRGQGTLVKVSS |
| 323 | 110Q | EVQLVESGGGLVQPGGSLRLSCAASGFTFSDYWMYWVRQAPG KGLEWVSEINTNGLITKYPDSVKGRFTISRDNAKNTLYLQMNSL RPEDTAVYYCARSPSGFNRGQGTLVQVSS |
| 324 | 112K | EVQLVESGGGLVQPGGSLRLSCAASGFTFSDYWMYWVRQAPG KGLEWVSEINTNGLITKYPDSVKGRFTISRDNAKNTLYLQMNSL RPEDTAVYYCARSPSGFNRGQGTLVTVKS |
| 325 | 112Q | EVQLVESGGGLVQPGGSLRLSCAASGFTFSDYWMYWVRQAPG KGLEWVSEINTNGLITKYPDSVKGRFTISRDNAKNTLYLQMNSL RPEDTAVYYCARSPSGFNRGQGTLVTVQS |
| 326 | 89T | EVQLVESGGGLVQPGGSLRLSCAASGFTFSDYWMYWVRQAPG KGLEWVSEINTNGLITKYPDSVKGRFTISRDNAKNTLYLQMNSL RPEDTATYYCARSPSGFNRGQGTLVTVSS |
| 327 | 11V + 89L | EVQLVESGGGVVQPGGSLRLSCAASGFTFSDYWMYWVRQAPG KGLEWVSEINTNGLITKYPDSVKGRFTISRDNAKNTLYLQMNSL RPEDTALYYCARSPSGFNRGQGTLVTVSS |
| 328 | 11V + 89L + 110K | EVQLVESGGGVVQPGGSLRLSCAASGFTFSDYWMYWVRQAPG KGLEWVSEINTNGLITKYPDSVKGRFTISRDNAKNTLYLQMNSL RPEDTALYYCARSPSGFNRGQGTLVKVSS |
| 329 | 11V + 89L + 110Q | EVQLVESGGGVVQPGGSLRLSCAASGFTFSDYWMYWVRQAPG KGLEWVSEINTNGLITKYPDSVKGRFTISRDNAKNTLYLQMNSL RPEDTALYYCARSPSGFNRGQGTLVQVSS |

Figure 17A (continued)

| SEQ ID | Mutation(s) | Sequence |
|---|---|---|
| 330 | 11V + 110K | EVQLVESGGGVVQPGGSLRLSCAASGFTFSDYWMYWVRQAPGKGLEWVSEINTNGLITKYPDSVKGRFTISRDNAKNTLYLQMNSLRPEDTAVYYCARSPSGFNRGQGTLVKVSS |
| 331 | 11V + 110Q | EVQLVESGGGVVQPGGSLRLSCAASGFTFSDYWMYWVRQAPGKGLEWVSEINTNGLITKYPDSVKGRFTISRDNAKNTLYLQMNSLRPEDTAVYYCARSPSGFNRGQGTLVQVSS |
| 332 | 11V + 112K | EVQLVESGGGVVQPGGSLRLSCAASGFTFSDYWMYWVRQAPGKGLEWVSEINTNGLITKYPDSVKGRFTISRDNAKNTLYLQMNSLRPEDTAVYYCARSPSGFNRGQGTLVTVKS |
| 333 | 11V + 112Q | EVQLVESGGGVVQPGGSLRLSCAASGFTFSDYWMYWVRQAPGKGLEWVSEINTNGLITKYPDSVKGRFTISRDNAKNTLYLQMNSLRPEDTAVYYCARSPSGFNRGQGTLVTVQS |

Figure 17B

| SEQ ID | Mutation(s) | Sequence |
|---|---|---|
| 334 | None (reference) | EVQLVESGGGLVQPGGSLRLSCTASGFTFSTADMGWFRQAPGK GREFVSRISGIDGTTYYDEPVKGRFTISRDNAKNTLYLQMNSLRP EDTAVYYCRSPRYADQWSAYDYWGQGTLVTVSS |
| 335 | CDR1 | TADMG |
| 336 | CDR2 | RISGIDGTTYYDEPVKG |
| 337 | CDR3 | PRYADQWSAYDY |
| 338 | 89L + 110K | EVQLVESGGGLVQPGGSLRLSCTASGFTFSTADMGWFRQAPGK GREFVSRISGIDGTTYYDEPVKGRFTISRDNAKNTLYLQMNSLRP EDTALYYCRSPRYADQWSAYDYWGQGTLVKVSS |
| 339 | 89L + 110Q | EVQLVESGGGLVQPGGSLRLSCTASGFTFSTADMGWFRQAPGK GREFVSRISGIDGTTYYDEPVKGRFTISRDNAKNTLYLQMNSLRP EDTALYYCRSPRYADQWSAYDYWGQGTLVQVSS |
| 340 | 110K | EVQLVESGGGLVQPGGSLRLSCTASGFTFSTADMGWFRQAPGK GREFVSRISGIDGTTYYDEPVKGRFTISRDNAKNTLYLQMNSLRP EDTAVYYCRSPRYADQWSAYDYWGQGTLVKVSS |
| 341 | 110Q | EVQLVESGGGLVQPGGSLRLSCTASGFTFSTADMGWFRQAPGK GREFVSRISGIDGTTYYDEPVKGRFTISRDNAKNTLYLQMNSLRP EDTAVYYCRSPRYADQWSAYDYWGQGTLVQVSS |
| 342 | 112K | EVQLVESGGGLVQPGGSLRLSCTASGFTFSTADMGWFRQAPGK GREFVSRISGIDGTTYYDEPVKGRFTISRDNAKNTLYLQMNSLRP EDTAVYYCRSPRYADQWSAYDYWGQGTLVTVKS |
| 343 | 112Q | EVQLVESGGGLVQPGGSLRLSCTASGFTFSTADMGWFRQAPGK GREFVSRISGIDGTTYYDEPVKGRFTISRDNAKNTLYLQMNSLRP EDTAVYYCRSPRYADQWSAYDYWGQGTLVTVQS |
| 344 | 89T | EVQLVESGGGLVQPGGSLRLSCTASGFTFSTADMGWFRQAPGK GREFVSRISGIDGTTYYDEPVKGRFTISRDNAKNTLYLQMNSLRP EDTATYYCRSPRYADQWSAYDYWGQGTLVTVSS |
| 345 | 11V + 89L | EVQLVESGGGVVQPGGSLRLSCTASGFTFSTADMGWFRQAPGK GREFVSRISGIDGTTYYDEPVKGRFTISRDNAKNTLYLQMNSLRP EDTALYYCRSPRYADQWSAYDYWGQGTLVTVSS |
| 346 | 11V + 89L + 110K | EVQLVESGGGVVQPGGSLRLSCTASGFTFSTADMGWFRQAPGK GREFVSRISGIDGTTYYDEPVKGRFTISRDNAKNTLYLQMNSLRP EDTALYYCRSPRYADQWSAYDYWGQGTLVKVSS |
| 347 | 11V + 89L + 110Q | EVQLVESGGGVVQPGGSLRLSCTASGFTFSTADMGWFRQAPGK GREFVSRISGIDGTTYYDEPVKGRFTISRDNAKNTLYLQMNSLRP EDTALYYCRSPRYADQWSAYDYWGQGTLVQVSS |

Figure 17B (continued)

| SEQ ID | Mutation(s) | Sequence |
|---|---|---|
| 348 | 11V + 110K | EVQLVESGGGVVQPGGSLRLSCTASGFTFSTADMGWFRQAPGK GREFVSRISGIDGTTYYDEPVKGRFTISRDNAKNTLYLQMNSLRP EDTAVYYCRSPRYADQWSAYDYWGQGTLVKVSS |
| 349 | 11V + 110Q | EVQLVESGGGVVQPGGSLRLSCTASGFTFSTADMGWFRQAPGK GREFVSRISGIDGTTYYDEPVKGRFTISRDNAKNTLYLQMNSLRP EDTAVYYCRSPRYADQWSAYDYWGQGTLVQVSS |
| 350 | 11V + 112K | EVQLVESGGGVVQPGGSLRLSCTASGFTFSTADMGWFRQAPGK GREFVSRISGIDGTTYYDEPVKGRFTISRDNAKNTLYLQMNSLRP EDTAVYYCRSPRYADQWSAYDYWGQGTLVTVKS |
| 351 | 11V + 112Q | EVQLVESGGGVVQPGGSLRLSCTASGFTFSTADMGWFRQAPGK GREFVSRISGIDGTTYYDEPVKGRFTISRDNAKNTLYLQMNSLRP EDTAVYYCRSPRYADQWSAYDYWGQGTLVTVQS |

Figure 18A

| SEQ ID | Mutation(s) | Sequence |
|---|---|---|
| 352 | None (reference) | DVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSS |
| 353 | CDR1 | YYAIG |
| 354 | CDR2 | CIDASDDITYYADSVKG |
| 355 | CDR3 | PIGLSSSCLLEYDYDY |
| 356 | 89L + 110K | DVQLVESGGGLVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVKVSS |
| 357 | 89L + 110Q | DVQLVESGGGLVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVQVSS |
| 358 | 110K | DVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVKVSS |
| 359 | 110Q | DVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVQVSS |
| 360 | 112K | DVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVKS |
| 361 | 112Q | DVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVQS |
| 362 | 89T | DVQLVESGGGLVQPGGSLRLSCAASGFILDYYAIGWFRQAPGKEREGVLCIDASDDITYYADSVKGRFTISRDNSKNTVYLQMNSLRPEDTATYYCATPIGLSSSCLLEYDYDYWGQGTLVTVSS |
| 363 | 11V + 89L | DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVTVSS |
| 364 | 11V + 89L + 110K | DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVKVSS |
| 365 | 11V + 89L + 110Q | DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVQVSS |

Figure 18A (continued)

| SEQ ID | Mutation(s) | Sequence |
|---|---|---|
| 366 | 11V + 110K | DVQLVESGGGVVQPGGSLRLSCAASGFILDYYAIGWFRQAPGK EREGVLCIDASDDITYYADSVKGRFTISRDNSKNTVYLQMNSLR PEDTAVYYCATPIGLSSSCLLEYDYDYWGQGTLVKVSS |
| 367 | 11V + 110Q | DVQLVESGGGVVQPGGSLRLSCAASGFILDYYAIGWFRQAPGK EREGVLCIDASDDITYYADSVKGRFTISRDNSKNTVYLQMNSLR PEDTAVYYCATPIGLSSSCLLEYDYDYWGQGTLVQVSS |
| 368 | 11V + 112K | DVQLVESGGGVVQPGGSLRLSCAASGFILDYYAIGWFRQAPGK EREGVLCIDASDDITYYADSVKGRFTISRDNSKNTVYLQMNSLR PEDTAVYYCATPIGLSSSCLLEYDYDYWGQGTLVTVKS |
| 369 | 11V + 112Q | DVQLVESGGGVVQPGGSLRLSCAASGFILDYYAIGWFRQAPGK EREGVLCIDASDDITYYADSVKGRFTISRDNSKNTVYLQMNSLR PEDTAVYYCATPIGLSSSCLLEYDYDYWGQGTLVTVQS |

Figure 18B

| SEQ ID | Mutation(s) | Sequence |
|---|---|---|
| 370 | None (reference) | DVQLVESGGGLVQPGGSLRLSCAASGFAFDDYAIGWFRQAPGE EREGVSSISSTYGLTYYADSVKGRFTISSDNSKNTVYLQMNSLRP EDTAVYYCAATPIGLIGLDAYEYDYWGQGTLVTVSS |
| 371 | CDR1 | DDYAIG |
| 372 | CDR2 | SISSTYGLTYYADSVKG |
| 373 | CDR3 | TPIGLIGLDAYEYDY |
| 374 | 89L + 110K | DVQLVESGGGLVQPGGSLRLSCAASGFAFDDYAIGWFRQAPGE EREGVSSISSTYGLTYYADSVKGRFTISSDNSKNTVYLQMNSLRP EDTALYYCAATPIGLIGLDAYEYDYWGQGTLVKVSS |
| 375 | 89L + 110Q | DVQLVESGGGLVQPGGSLRLSCAASGFAFDDYAIGWFRQAPGE EREGVSSISSTYGLTYYADSVKGRFTISSDNSKNTVYLQMNSLRP EDTALYYCAATPIGLIGLDAYEYDYWGQGTLVQVSS |
| 376 | 110K | DVQLVESGGGLVQPGGSLRLSCAASGFAFDDYAIGWFRQAPGE EREGVSSISSTYGLTYYADSVKGRFTISSDNSKNTVYLQMNSLRP EDTAVYYCAATPIGLIGLDAYEYDYWGQGTLVKVSS |
| 377 | 110Q | DVQLVESGGGLVQPGGSLRLSCAASGFAFDDYAIGWFRQAPGE EREGVSSISSTYGLTYYADSVKGRFTISSDNSKNTVYLQMNSLRP EDTAVYYCAATPIGLIGLDAYEYDYWGQGTLVQVSS |
| 378 | 112K | DVQLVESGGGLVQPGGSLRLSCAASGFAFDDYAIGWFRQAPGE EREGVSSISSTYGLTYYADSVKGRFTISSDNSKNTVYLQMNSLRP EDTAVYYCAATPIGLIGLDAYEYDYWGQGTLVTVKS |
| 379 | 112Q | DVQLVESGGGLVQPGGSLRLSCAASGFAFDDYAIGWFRQAPGE EREGVSSISSTYGLTYYADSVKGRFTISSDNSKNTVYLQMNSLRP EDTAVYYCAATPIGLIGLDAYEYDYWGQGTLVTVQS |
| 380 | 89T | DVQLVESGGGLVQPGGSLRLSCAASGFAFDDYAIGWFRQAPGE EREGVSSISSTYGLTYYADSVKGRFTISSDNSKNTVYLQMNSLRP EDTATYYCAATPIGLIGLDAYEYDYWGQGTLVTVSS |
| 381 | 11V + 89L | DVQLVESGGGVVQPGGSLRLSCAASGFAFDDYAIGWFRQAPGE EREGVSSISSTYGLTYYADSVKGRFTISSDNSKNTVYLQMNSLRP EDTALYYCAATPIGLIGLDAYEYDYWGQGTLVTVSS |
| 382 | 11V + 89L + 110K | DVQLVESGGGVVQPGGSLRLSCAASGFAFDDYAIGWFRQAPGE EREGVSSISSTYGLTYYADSVKGRFTISSDNSKNTVYLQMNSLRP EDTALYYCAATPIGLIGLDAYEYDYWGQGTLVKVSS |
| 383 | 11V + 89L + 110Q | DVQLVESGGGVVQPGGSLRLSCAASGFAFDDYAIGWFRQAPGE EREGVSSISSTYGLTYYADSVKGRFTISSDNSKNTVYLQMNSLRP EDTALYYCAATPIGLIGLDAYEYDYWGQGTLVQVSS |

Figure 18B (continued)

| SEQ ID | Mutation(s) | Sequence |
|---|---|---|
| 384 | 11V + 110K | DVQLVESGGGVVQPGGSLRLSCAASGFAFDDYAIGWFRQAPGE EREGVSSISSTYGLTYYADSVKGRFTISSDNSKNTVYLQMNSLRP EDTAVYYCAATPIGLIGLDAYEYDYWGQGTLVKVSS |
| 385 | 11V + 110Q | DVQLVESGGGVVQPGGSLRLSCAASGFAFDDYAIGWFRQAPGE EREGVSSISSTYGLTYYADSVKGRFTISSDNSKNTVYLQMNSLRP EDTAVYYCAATPIGLIGLDAYEYDYWGQGTLVQVSS |
| 386 | 11V + 112K | DVQLVESGGGVVQPGGSLRLSCAASGFAFDDYAIGWFRQAPGE EREGVSSISSTYGLTYYADSVKGRFTISSDNSKNTVYLQMNSLRP EDTAVYYCAATPIGLIGLDAYEYDYWGQGTLVTVKS |
| 387 | 11V + 112Q | DVQLVESGGGVVQPGGSLRLSCAASGFAFDDYAIGWFRQAPGE EREGVSSISSTYGLTYYADSVKGRFTISSDNSKNTVYLQMNSLRP EDTAVYYCAATPIGLIGLDAYEYDYWGQGTLVTVQS |

Figure 19

| SEQ ID | Mutation(s) | Sequence |
|---|---|---|
| 388 | None (reference) | EVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVSS |
| 389 | CDR1 | SYPMG |
| 390 | CDR2 | SITGSGGSTYYADSVKG |
| 391 | CDR3 | YIRPDTYLSRDYRKYDY |
| 392 | 89L + 110K | EVQLVESGGGLVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVKVSS |
| 393 | 89L + 110Q | EVQLVESGGGLVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVQVSS |
| 394 | 110K | EVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVKVSS |
| 395 | 110Q | EVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVQVSS |
| 396 | 112K | EVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVKS |
| 397 | 112Q | EVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVQS |
| 398 | 89T | EVQLVESGGGLVQPGGSLRLSCAASGFTFSSYPMGWFRQAPGKGREFVSSITGSGGSTYYADSVKGRFTISRDNAKNTLYLQMNSLRPEDTATYYCAAYIRPDTYLSRDYRKYDYWGQGTLVTVSS |
| 399 | 11V + 89L | EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSS |
| 400 | 11V + 89L + 110K | EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVKVSS |
| 401 | 11V + 89L + 110Q | EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVQVSS |

Figure 19 (continued)

| SEQ ID | Mutation(s) | Sequence |
|---|---|---|
| 402 | 11V + 110K | EVQLVESGGGVVQPGGSLRLSCAASGFTFSSYPMGWFRQAPGK GREFVSSITGSGGSTYYADSVKGRFTISRDNAKNTLYLQMNSLR PEDTAVYYCAAYIRPDTYLSRDYRKYDYWGQGTLVKVSS |
| 403 | 11V + 110Q | EVQLVESGGGVVQPGGSLRLSCAASGFTFSSYPMGWFRQAPGK GREFVSSITGSGGSTYYADSVKGRFTISRDNAKNTLYLQMNSLR PEDTAVYYCAAYIRPDTYLSRDYRKYDYWGQGTLVQVSS |
| 404 | 11V + 112K | EVQLVESGGGVVQPGGSLRLSCAASGFTFSSYPMGWFRQAPGK GREFVSSITGSGGSTYYADSVKGRFTISRDNAKNTLYLQMNSLR PEDTAVYYCAAYIRPDTYLSRDYRKYDYWGQGTLVTVKS |
| 405 | 11V + 112Q | EVQLVESGGGVVQPGGSLRLSCAASGFTFSSYPMGWFRQAPGK GREFVSSITGSGGSTYYADSVKGRFTISRDNAKNTLYLQMNSLR PEDTAVYYCAAYIRPDTYLSRDYRKYDYWGQGTLVTVQS |

Figure 20A

| SEQ ID | Mutation(s) | Sequence |
|---|---|---|
| 406 | None (reference) | EVQLVESGGGLVQPGGSLRISCAASGSIYLINYMGWYRQAPGKQ RELVATLTSGGSTNYAGSVKGRFAISRDNAKNTVYLQMNSLKP EDTAVYYCNIGGTLYDRRRFESWGQGTLVTVSS |
| 407 | CDR1 | INYMG |
| 408 | CDR2 | TLTSGGSTNYAGSVKG |
| 409 | CDR3 | GGTLYDRRRFES |
| 410 | 89L + 110K | EVQLVESGGGLVQPGGSLRISCAASGSIYLINYMGWYRQAPGKQ RELVATLTSGGSTNYAGSVKGRFAISRDNAKNTVYLQMNSLKP EDTALYYCNIGGTLYDRRRFESWGQGTLVKVSS |
| 411 | 89L + 110Q | EVQLVESGGGLVQPGGSLRISCAASGSIYLINYMGWYRQAPGKQ RELVATLTSGGSTNYAGSVKGRFAISRDNAKNTVYLQMNSLKP EDTALYYCNIGGTLYDRRRFESWGQGTLVQVSS |
| 412 | 110K | EVQLVESGGGLVQPGGSLRISCAASGSIYLINYMGWYRQAPGKQ RELVATLTSGGSTNYAGSVKGRFAISRDNAKNTVYLQMNSLKP EDTAVYYCNIGGTLYDRRRFESWGQGTLVKVSS |
| 413 | 110Q | EVQLVESGGGLVQPGGSLRISCAASGSIYLINYMGWYRQAPGKQ RELVATLTSGGSTNYAGSVKGRFAISRDNAKNTVYLQMNSLKP EDTAVYYCNIGGTLYDRRRFESWGQGTLVQVSS |
| 414 | 112K | EVQLVESGGGLVQPGGSLRISCAASGSIYLINYMGWYRQAPGKQ RELVATLTSGGSTNYAGSVKGRFAISRDNAKNTVYLQMNSLKP EDTAVYYCNIGGTLYDRRRFESWGQGTLVTVKS |
| 415 | 112Q | EVQLVESGGGLVQPGGSLRISCAASGSIYLINYMGWYRQAPGKQ RELVATLTSGGSTNYAGSVKGRFAISRDNAKNTVYLQMNSLKP EDTAVYYCNIGGTLYDRRRFESWGQGTLVTVQS |
| 416 | 89T | EVQLVESGGGLVQPGGSLRISCAASGSIYLINYMGWYRQAPGKQ RELVATLTSGGSTNYAGSVKGRFAISRDNAKNTVYLQMNSLKP EDTATYYCNIGGTLYDRRRFESWGQGTLVTVSS |
| 417 | 11V + 89L | EVQLVESGGGVVQPGGSLRISCAASGSIYLINYMGWYRQAPGK QRELVATLTSGGSTNYAGSVKGRFAISRDNAKNTVYLQMNSLK PEDTALYYCNIGGTLYDRRRFESWGQGTLVTVSS |
| 418 | 11V + 89L + 110K | EVQLVESGGGVVQPGGSLRISCAASGSIYLINYMGWYRQAPGK QRELVATLTSGGSTNYAGSVKGRFAISRDNAKNTVYLQMNSLK PEDTALYYCNIGGTLYDRRRFESWGQGTLVKVSS |
| 419 | 11V + 89L + 110Q | EVQLVESGGGVVQPGGSLRISCAASGSIYLINYMGWYRQAPGK QRELVATLTSGGSTNYAGSVKGRFAISRDNAKNTVYLQMNSLK PEDTALYYCNIGGTLYDRRRFESWGQGTLVQVSS |

Figure 20A (continued)

| SEQ ID | Mutation(s) | Sequence |
|---|---|---|
| 420 | 11V + 110K | EVQLVESGGGVVQPGGSLRISCAASGSIYLINYMGWYRQAPGK QRELVATLTSGGSTNYAGSVKGRFAISRDNAKNTVYLQMNSLK PEDTAVYYCNIGGTLYDRRRFESWGQGTLVKVSS |
| 421 | 11V + 110Q | EVQLVESGGGVVQPGGSLRISCAASGSIYLINYMGWYRQAPGK QRELVATLTSGGSTNYAGSVKGRFAISRDNAKNTVYLQMNSLK PEDTAVYYCNIGGTLYDRRRFESWGQGTLVQVSS |
| 422 | 11V + 112K | EVQLVESGGGVVQPGGSLRISCAASGSIYLINYMGWYRQAPGK QRELVATLTSGGSTNYAGSVKGRFAISRDNAKNTVYLQMNSLK PEDTAVYYCNIGGTLYDRRRFESWGQGTLVTVKS |
| 423 | 11V + 112Q | EVQLVESGGGVVQPGGSLRISCAASGSIYLINYMGWYRQAPGK QRELVATLTSGGSTNYAGSVKGRFAISRDNAKNTVYLQMNSLK PEDTAVYYCNIGGTLYDRRRFESWGQGTLVQVSS |

Figure 20B

| SEQ ID | Mutation(s) | Sequence |
|---|---|---|
| 424 | None (reference) | EVQLVESGGGLVQTGASLRLSCAASGRTFSNYAMGWFRQAPGKERERVAAITPRAFTTYYADSVKGRFTISRDNAKNTAYLQMVSLKPEDTAVYYCAAQLVGSGSNLGRQESYAYWGQGTLVTVSS |
| 425 | CDR1 | NYAMG |
| 426 | CDR2 | AITPRAFTTYYADSVKG |
| 427 | CDR3 | QLVGSGSNLGRQESYAY |
| 428 | 89L + 110K | EVQLVESGGGLVQTGASLRLSCAASGRTFSNYAMGWFRQAPGKERERVAAITPRAFTTYYADSVKGRFTISRDNAKNTAYLQMVSLKPEDTALYYCAAQLVGSGSNLGRQESYAYWGQGTLVKVSS |
| 429 | 89L + 110Q | EVQLVESGGGLVQTGASLRLSCAASGRTFSNYAMGWFRQAPGKERERVAAITPRAFTTYYADSVKGRFTISRDNAKNTAYLQMVSLKPEDTALYYCAAQLVGSGSNLGRQESYAYWGQGTLVQVSS |
| 430 | 110K | EVQLVESGGGLVQTGASLRLSCAASGRTFSNYAMGWFRQAPGKERERVAAITPRAFTTYYADSVKGRFTISRDNAKNTAYLQMVSLKPEDTAVYYCAAQLVGSGSNLGRQESYAYWGQGTLVKVSS |
| 431 | 110Q | EVQLVESGGGLVQTGASLRLSCAASGRTFSNYAMGWFRQAPGKERERVAAITPRAFTTYYADSVKGRFTISRDNAKNTAYLQMVSLKPEDTAVYYCAAQLVGSGSNLGRQESYAYWGQGTLVQVSS |
| 432 | 112K | EVQLVESGGGLVQTGASLRLSCAASGRTFSNYAMGWFRQAPGKERERVAAITPRAFTTYYADSVKGRFTISRDNAKNTAYLQMVSLKPEDTAVYYCAAQLVGSGSNLGRQESYAYWGQGTLVTVKS |
| 433 | 112Q | EVQLVESGGGLVQTGASLRLSCAASGRTFSNYAMGWFRQAPGKERERVAAITPRAFTTYYADSVKGRFTISRDNAKNTAYLQMVSLKPEDTAVYYCAAQLVGSGSNLGRQESYAYWGQGTLVTVQS |
| 434 | 89T | EVQLVESGGGLVQTGASLRLSCAASGRTFSNYAMGWFRQAPGKERERVAAITPRAFTTYYADSVKGRFTISRDNAKNTAYLQMVSLKPEDTATYYCAAQLVGSGSNLGRQESYAYWGQGTLVTVSS |
| 435 | 11V + 89L | EVQLVESGGGVVQTGASLRLSCAASGRTFSNYAMGWFRQAPGKERERVAAITPRAFTTYYADSVKGRFTISRDNAKNTAYLQMVSLKPEDTALYYCAAQLVGSGSNLGRQESYAYWGQGTLVTVSS |
| 436 | 11V + 89L + 110K | EVQLVESGGGVVQTGASLRLSCAASGRTFSNYAMGWFRQAPGKERERVAAITPRAFTTYYADSVKGRFTISRDNAKNTAYLQMVSLKPEDTALYYCAAQLVGSGSNLGRQESYAYWGQGTLVKVSS |
| 437 | 11V + 89L + 110Q | EVQLVESGGGVVQTGASLRLSCAASGRTFSNYAMGWFRQAPGKERERVAAITPRAFTTYYADSVKGRFTISRDNAKNTAYLQMVSLKPEDTALYYCAAQLVGSGSNLGRQESYAYWGQGTLVQVSS |

Figure 20B (continued)

| SEQ ID | Mutation(s) | Sequence |
|---|---|---|
| 438 | 11V + 110K | EVQLVESGGGVVQTGASLRLSCAASGRTFSNYAMGWFRQAPG KERERVAAITPRAFTTYYADSVKGRFTISRDNAKNTAYLQMVSL KPEDTAVYYCAAQLVGSGSNLGRQESYAYWGQGTLVKVSS |
| 439 | 11V + 110Q | EVQLVESGGGVVQTGASLRLSCAASGRTFSNYAMGWFRQAPG KERERVAAITPRAFTTYYADSVKGRFTISRDNAKNTAYLQMVSL KPEDTAVYYCAAQLVGSGSNLGRQESYAYWGQGTLVQVSS |
| 440 | 11V + 112K | EVQLVESGGGVVQTGASLRLSCAASGRTFSNYAMGWFRQAPG KERERVAAITPRAFTTYYADSVKGRFTISRDNAKNTAYLQMVSL KPEDTAVYYCAAQLVGSGSNLGRQESYAYWGQGTLVTVKS |
| 441 | 11V + 112Q | EVQLVESGGGVVQTGASLRLSCAASGRTFSNYAMGWFRQAPG KERERVAAITPRAFTTYYADSVKGRFTISRDNAKNTAYLQMVSL KPEDTAVYYCAAQLVGSGSNLGRQESYAYWGQGTLVTVQS |

Figure 20C

| SEQ ID | Mutation(s) | Sequence |
|---|---|---|
| 442 | None (reference) | EVQLVESGGGLVQAGESLTLSCAASGRTLSAYIMGWFRQAPGK EREFVAGIWSGGYTHLADSAKGRFSISRDNAKNTVYLQMNGLK PEDTAVYYCAAGLRGRQYSNWGQGTLVTVSS |
| 443 | CDR1 | AYIMG |
| 444 | CDR2 | GIWSGGYTHLADSAKG |
| 445 | CDR3 | GIWSGGYTHLADSAKG |
| 446 | 89L + 110K | EVQLVESGGGLVQAGESLTLSCAASGRTLSAYIMGWFRQAPGK EREFVAGIWSGGYTHLADSAKGRFSISRDNAKNTVYLQMNGLK PEDTALYYCAAGLRGRQYSNWGQGTLVKVSS |
| 447 | 89L + 110Q | EVQLVESGGGLVQAGESLTLSCAASGRTLSAYIMGWFRQAPGK EREFVAGIWSGGYTHLADSAKGRFSISRDNAKNTVYLQMNGLK PEDTALYYCAAGLRGRQYSNWGQGTLVQVSS |
| 448 | 110K | EVQLVESGGGLVQAGESLTLSCAASGRTLSAYIMGWFRQAPGK EREFVAGIWSGGYTHLADSAKGRFSISRDNAKNTVYLQMNGLK PEDTAVYYCAAGLRGRQYSNWGQGTLVKVSS |
| 449 | 110Q | EVQLVESGGGLVQAGESLTLSCAASGRTLSAYIMGWFRQAPGK EREFVAGIWSGGYTHLADSAKGRFSISRDNAKNTVYLQMNGLK PEDTAVYYCAAGLRGRQYSNWGQGTLVQVSS |
| 450 | 112K | EVQLVESGGGLVQAGESLTLSCAASGRTLSAYIMGWFRQAPGK EREFVAGIWSGGYTHLADSAKGRFSISRDNAKNTVYLQMNGLK PEDTAVYYCAAGLRGRQYSNWGQGTLVTVKS |
| 451 | 112Q | EVQLVESGGGLVQAGESLTLSCAASGRTLSAYIMGWFRQAPGK EREFVAGIWSGGYTHLADSAKGRFSISRDNAKNTVYLQMNGLK PEDTAVYYCAAGLRGRQYSNWGQGTLVTVKS |
| 452 | 89T | EVQLVESGGGLVQAGESLTLSCAASGRTLSAYIMGWFRQAPGK EREFVAGIWSGGYTHLADSAKGRFSISRDNAKNTVYLQMNGLK PEDTATYYCAAGLRGRQYSNWGQGTLVTVSS |
| 453 | 11V + 89L | EVQLVESGGGVVQAGESLTLSCAASGRTLSAYIMGWFRQAPGK EREFVAGIWSGGYTHLADSAKGRFSISRDNAKNTVYLQMNGLK PEDTALYYCAAGLRGRQYSNWGQGTLVTVSS |
| 454 | 11V + 89L + 110K | EVQLVESGGGVVQAGESLTLSCAASGRTLSAYIMGWFRQAPGK EREFVAGIWSGGYTHLADSAKGRFSISRDNAKNTVYLQMNGLK PEDTALYYCAAGLRGRQYSNWGQGTLVKVSS |
| 455 | 11V + 89L + 110Q | EVQLVESGGGVVQAGESLTLSCAASGRTLSAYIMGWFRQAPGK EREFVAGIWSGGYTHLADSAKGRFSISRDNAKNTVYLQMNGLK PEDTALYYCAAGLRGRQYSNWGQGTLVQVSS |

Figure 20C (continued)

| SEQ ID | Mutation(s) | Sequence |
|---|---|---|
| 456 | 11V + 110K | EVQLVESGGGVVQAGESLTLSCAASGRTLSAYIMGWFRQAPGK EREFVAGIWSGGYTHLADSAKGRFSISRDNAKNTVYLQMNGLK PEDTAVYYCAAGLRGRQYSNWGQGTLVKVSS |
| 457 | 11V + 110Q | EVQLVESGGGVVQAGESLTLSCAASGRTLSAYIMGWFRQAPGK EREFVAGIWSGGYTHLADSAKGRFSISRDNAKNTVYLQMNGLK PEDTAVYYCAAGLRGRQYSNWGQGTLVQVSS |
| 458 | 11V + 112K | EVQLVESGGGVVQAGESLTLSCAASGRTLSAYIMGWFRQAPGK EREFVAGIWSGGYTHLADSAKGRFSISRDNAKNTVYLQMNGLK PEDTAVYYCAAGLRGRQYSNWGQGTLVTVKS |
| 459 | 11V + 112Q | EVQLVESGGGVVQAGESLTLSCAASGRTLSAYIMGWFRQAPGK EREFVAGIWSGGYTHLADSAKGRFSISRDNAKNTVYLQMNGLK PEDTAVYYCAAGLRGRQYSNWGQGTLVTVQS |

Figure 21A

| SEQ ID | Mutation(s) | Sequence |
|---|---|---|
| 460 | lead | EVQLLESGGGLVQPGGSLRLSCVHSGPTFRTDTMGWFRQAPGK GREFVAAVTWNSGRINYADSVKGRFTISRDNSKNTAYLQMNSL RPEDTAVYYCAAHRFVVGGNRVEDWRYWGQGTLVTVSS |
| 461 | CDR1 | TDTMG |
| 462 | CDR2 | AVTWNSGRINYADSVKG |
| 463 | CDR3 | HRFVVGGNRVEDWRY |
| 464 | 89L + 110K | EVQLLESGGGLVQPGGSLRLSCVHSGPTFRTDTMGWFRQAPGK GREFVAAVTWNSGRINYADSVKGRFTISRDNSKNTALLQMNSL RPEDTAVYYCAAHRFVVGGNRVEDWRYWGQGTLVKVSS |
| 465 | 89L + 110Q | EVQLLESGGGLVQPGGSLRLSCVHSGPTFRTDTMGWFRQAPGK GREFVAAVTWNSGRINYADSVKGRFTISRDNSKNTALLQMNSL RPEDTAVYYCAAHRFVVGGNRVEDWRYWGQGTLVQVSS |
| 466 | 110K | EVQLLESGGGLVQPGGSLRLSCVHSGPTFRTDTMGWFRQAPGK GREFVAAVTWNSGRINYADSVKGRFTISRDNSKNTAYLQMNSL RPEDTAVYYCAAHRFVVGGNRVEDWRYWGQGTLVKVSS |
| 467 | 110Q | EVQLLESGGGLVQPGGSLRLSCVHSGPTFRTDTMGWFRQAPGK GREFVAAVTWNSGRINYADSVKGRFTISRDNSKNTAYLQMNSL RPEDTAVYYCAAHRFVVGGNRVEDWRYWGQGTLVQVSS |
| 468 | 112K | EVQLLESGGGLVQPGGSLRLSCVHSGPTFRTDTMGWFRQAPGK GREFVAAVTWNSGRINYADSVKGRFTISRDNSKNTAYLQMNSL RPEDTAVYYCAAHRFVVGGNRVEDWRYWGQGTLVTVKS |
| 469 | 112Q | EVQLLESGGGLVQPGGSLRLSCVHSGPTFRTDTMGWFRQAPGK GREFVAAVTWNSGRINYADSVKGRFTISRDNSKNTAYLQMNSL RPEDTAVYYCAAHRFVVGGNRVEDWRYWGQGTLVTVQS |
| 470 | 89T | EVQLLESGGGLVQPGGSLRLSCVHSGPTFRTDTMGWFRQAPGK GREFVAAVTWNSGRINYADSVKGRFTISRDNSKNTATLQMNSL RPEDTAVYYCAAHRFVVGGNRVEDWRYWGQGTLVTVSS |
| 471 | 11V + 89L | EVQLLESGGGVVQPGGSLRLSCVHSGPTFRTDTMGWFRQAPGK GREFVAAVTWNSGRINYADSVKGRFTISRDNSKNTALLQMNSL RPEDTAVYYCAAHRFVVGGNRVEDWRYWGQGTLVTVSS |
| 472 | 11V + 89L + 110K | EVQLLESGGGVVQPGGSLRLSCVHSGPTFRTDTMGWFRQAPGK GREFVAAVTWNSGRINYADSVKGRFTISRDNSKNTALLQMNSL RPEDTAVYYCAAHRFVVGGNRVEDWRYWGQGTLVKVSS |
| 473 | 11V + 89L + 110Q | EVQLLESGGGVVQPGGSLRLSCVHSGPTFRTDTMGWFRQAPGK GREFVAAVTWNSGRINYADSVKGRFTISRDNSKNTALLQMNSL RPEDTAVYYCAAHRFVVGGNRVEDWRYWGQGTLVQVSS |

Figure 21A (continued)

| SEQ ID | Mutation(s) | Sequence |
|---|---|---|
| 474 | 11V + 110K | EVQLLESGGGVVQPGGSLRLSCVHSGPTFRTDTMGWFRQAPGK GREFVAAVTWNSGRINYADSVKGRFTISRDNSKNTAYLQMNSL RPEDTAVYYCAAHRFVVGGNRVEDWRYWGQGTLVKVSS |
| 475 | 11V + 110Q | EVQLLESGGGVVQPGGSLRLSCVHSGPTFRTDTMGWFRQAPGK GREFVAAVTWNSGRINYADSVKGRFTISRDNSKNTAYLQMNSL RPEDTAVYYCAAHRFVVGGNRVEDWRYWGQGTLVQVSS |
| 476 | 11V + 112K | EVQLLESGGGVVQPGGSLRLSCVHSGPTFRTDTMGWFRQAPGK GREFVAAVTWNSGRINYADSVKGRFTISRDNSKNTAYLQMNSL RPEDTAVYYCAAHRFVVGGNRVEDWRYWGQGTLVTVKS |
| 477 | 11V + 112Q | EVQLLESGGGVVQPGGSLRLSCVHSGPTFRTDTMGWFRQAPGK GREFVAAVTWNSGRINYADSVKGRFTISRDNSKNTAYLQMNSL RPEDTAVYYCAAHRFVVGGNRVEDWRYWGQGTLVTVQS |

Figure 21B

| SEQ ID | Mutation(s) | Sequence |
|---|---|---|
| 478 | lead | EVQLLESGGGLVQPGGSLRLSCAASGRTFNNYNMGWFRQAPGKGREFVAAVSRSGVSTYYADSVKGRFTISRDNSKNTVYLQMNSLRPEDTAVYYCAAAYRGTAINVRRSYSSWGQGTLVTVSS |
| 479 | CDR1 | NYNMG |
| 480 | CDR2 | AVSRSGVSTYYADSVKG |
| 481 | CDR3 | AYRGTAINVRRSYSS |
| 482 | 89L + 110K | EVQLLESGGGLVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSS |
| 483 | 89L + 110Q | EVQLLESGGGLVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVQVSS |
| 484 | 110K | EVQLLESGGGLVQPGGSLRLSCAASGRTFNNYNMGWFRQAPGKGREFVAAVSRSGVSTYYADSVKGRFTISRDNSKNTVYLQMNSLRPEDTAVYYCAAAYRGTAINVRRSYSSWGQGTLVKVSS |
| 485 | 110Q | EVQLLESGGGLVQPGGSLRLSCAASGRTFNNYNMGWFRQAPGKGREFVAAVSRSGVSTYYADSVKGRFTISRDNSKNTVYLQMNSLRPEDTAVYYCAAAYRGTAINVRRSYSSWGQGTLVQVSS |
| 486 | 112K | EVQLLESGGGLVQPGGSLRLSCAASGRTFNNYNMGWFRQAPGKGREFVAAVSRSGVSTYYADSVKGRFTISRDNSKNTVYLQMNSLRPEDTAVYYCAAAYRGTAINVRRSYSSWGQGTLVTVKS |
| 487 | 112Q | EVQLLESGGGLVQPGGSLRLSCAASGRTFNNYNMGWFRQAPGKGREFVAAVSRSGVSTYYADSVKGRFTISRDNSKNTVYLQMNSLRPEDTAVYYCAAAYRGTAINVRRSYSSWGQGTLVTVQS |
| 488 | 89T | EVQLLESGGGLVQPGGSLRLSCAASGRTFNNYNMGWFRQAPGKGREFVAAVSRSGVSTYYADSVKGRFTISRDNSKNTVYLQMNSLRPEDTATYYCAAAYRGTAINVRRSYSSWGQGTLVTVSS |
| 489 | 11V + 89L | EVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSS |
| 490 | 11V + 89L + 110K | EVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSS |
| 491 | 11V + 89L + 110Q | EVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSS |

Figure 21B (continued)

| SEQ ID | Mutation(s) | Sequence |
|---|---|---|
| 492 | 11V + 110K | EVQLLESGGGVVQPGGSLRLSCAASGRTFNNYNMGWFRQAPG KGREFVAAVSRSGVSTYYADSVKGRFTISRDNSKNTVYLQMNS LRPEDTAVYYCAAAYRGTAINVRRSYSSWGQGTLVKVSS |
| 493 | 11V + 110Q | EVQLLESGGGVVQPGGSLRLSCAASGRTFNNYNMGWFRQAPG KGREFVAAVSRSGVSTYYADSVKGRFTISRDNSKNTVYLQMNS LRPEDTAVYYCAAAYRGTAINVRRSYSSWGQGTLVQVSS |
| 494 | 11V + 112K | EVQLLESGGGVVQPGGSLRLSCAASGRTFNNYNMGWFRQAPG KGREFVAAVSRSGVSTYYADSVKGRFTISRDNSKNTVYLQMNS LRPEDTAVYYCAAAYRGTAINVRRSYSSWGQGTLVTVKS |
| 495 | 11V + 112Q | EVQLLESGGGVVQPGGSLRLSCAASGRTFNNYNMGWFRQAPG KGREFVAAVSRSGVSTYYADSVKGRFTISRDNSKNTVYLQMNS LRPEDTAVYYCAAAYRGTAINVRRSYSSWGQGTLVTVQS |

Figure 22

| SEQ ID | Sequence |
|---|---|
| 514 | EVQLLESGGGVVQPGGSLRLSCAASGRIFSLPASGNIFNLLTIAWYRQAPGKGREL VATINSGSRTYYADSVKGRFTISRDNSKKTVYLQMNSLRPEDTALYYCQTSGSGS PNFWGQGTLVTVSSGGGGSGGGSEVQLVESGGGLVQPGNSLRLSCAASGFTFSSF GMSWVRQAPGKGLEWVSSISGSGSDTLYADSVKGRFTISRDNAKTTLYLQMNSL RPEDTAVYYCTIGGSLSRSSQGTLVTVSSGGGGSGGGSEVQLLESGGGVVQPGGS LRLSCAASGRTLSSYAMGWFRQAPGKGREFVARISQGGTAIYYADSVKGRFTISR DNSKNTLYLQMNSLRPEDTALYYCAKDPSPYYRGSAYLLSGSYDSWGQGTLVT VSSA |
| 515 | EVQLLESGGGVVQPGGSLRLSCAASGRIFSLPASGNIFNLLTIAWYRQAPGKGREL VATINSGSRTYYADSVKGRFTISRDNSKKTVYLQMNSLRPEDTALYYCQTSGSGS PNFWGQGTLVTVSSGGGGSGGGSEVQLVESGGGLVQPGNSLRLSCAASGFTFSSF GMSWVRQAPGKGLEWVSSISGSGSDTLYADSVKGRFTISRDNAKTTLYLQMNSL RPEDTAVYYCTIGGSLSRSSQGTLVTVSSGGGGSGGGSEVQLLESGGGVVQPGGS LRLSCAASGRTLSSYAMGWFRQAPGKGREFVARISQGGTAIYYADSVKGRFTISR DNSKNTLYLQMNSLRPEDTALYYCAKDPSPYYRGSAYLLSGSYDSWGQGTLVK VSSA |
| 516 | EVQLLESGGGVVQPGGSLRLSCAASGRIFSLPASGNIFNLLTIAWYRQAPGKGREL VATINSGSRTYYADSVKGRFTISRDNSKKTVYLQMNSLRPEDTALYYCQTSGSGS PNFWGQGTLVTVSSGGGGSGGGSEVQLVESGGGLVQPGNSLRLSCAASGFTFSSF GMSWVRQAPGKGLEWVSSISGSGSDTLYADSVKGRFTISRDNAKTTLYLQMNSL RPEDTAVYYCTIGGSLSRSSQGTLVTVSSGGGGSGGGSEVQLLESGGGVVQPGGS LRLSCAASGRTLSSYAMGWFRQAPGKGREFVARISQGGTAIYYADSVKGRFTISR DNSKNTLYLQMNSLRPEDTALYYCAKDPSPYYRGSAYLLSGSYDSWGQGTLVQ VSSA |
| 517 | EVQLLESGGGVVQPGGSLRLSCAASGRIFSLPASGNIFNLLTIAWYRQAPGKGREL VATINSGSRTYYADSVKGRFTISRDNSKKTVYLQMNSLRPEDTALYYCQTSGSGS PNFWGQGTLVTVSSGGGGSGGGSEVQLVESGGGVVQPGNSLRLSCAASGFTFSS FGMSWVRQAPGKGLEWVSSISGSGSDTLYADSVKGRFTISRDNAKTTLYLQMNS LRPEDTALYYCTIGGSLSRSSQGTLVTVSSGGGGSGGGSEVQLLESGGGVVQPGG SLRLSCAASGRTLSSYAMGWFRQAPGKGREFVARISQGGTAIYYADSVKGRFTIS RDNSKNTLYLQMNSLRPEDTALYYCAKDPSPYYRGSAYLLSGSYDSWGQGTLV TVSSA |
| 518 | EVQLLESGGGVVQPGGSLRLSCAASGRIFSLPASGNIFNLLTIAWYRQAPGKGREL VATINSGSRTYYADSVKGRFTISRDNSKKTVYLQMNSLRPEDTALYYCQTSGSGS PNFWGQGTLVTVSSGGGGSGGGSEVQLVESGGGVVQPGNSLRLSCAASGFTFSS FGMSWVRQAPGKGLEWVSSISGSGSDTLYADSVKGRFTISRDNAKTTLYLQMNS LRPEDTALYYCTIGGSLSRSSQGTLVTVSSGGGGSGGGSEVQLLESGGGVVQPGG SLRLSCAASGRTLSSYAMGWFRQAPGKGREFVARISQGGTAIYYADSVKGRFTIS RDNSKNTLYLQMNSLRPEDTALYYCAKDPSPYYRGSAYLLSGSYDSWGQGTLV KVSSA |
| 519 | EVQLLESGGGVVQPGGSLRLSCAASGRIFSLPASGNIFNLLTIAWYRQAPGKGREL VATINSGSRTYYADSVKGRFTISRDNSKKTVYLQMNSLRPEDTALYYCQTSGSGS PNFWGQGTLVTVSSGGGGSGGGSEVQLVESGGGVVQPGNSLRLSCAASGFTFSS FGMSWVRQAPGKGLEWVSSISGSGSDTLYADSVKGRFTISRDNAKTTLYLQMNS LRPEDTALYYCTIGGSLSRSSQGTLVTVSSGGGGSGGGSEVQLLESGGGVVQPGG SLRLSCAASGRTLSSYAMGWFRQAPGKGREFVARISQGGTAIYYADSVKGRFTIS RDNSKNTLYLQMNSLRPEDTALYYCAKDPSPYYRGSAYLLSGSYDSWGQGTLV QVSSA |

Figure 22 (continued)

| SEQ ID | Sequence |
|---|---|
| 520 | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVTVSSA |
| 521 | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVKVSSA |
| 522 | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVQVSSA |
| 523 | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVTVSSA |
| 524 | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVKVSSA |
| 525 | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVQVSSA |

Figure 22 (continued)

| SEQ ID | Sequence |
|---|---|
| 526 | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVTVSSA |
| 527 | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVKVSSA |
| 528 | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVQVSSA |
| 529 | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVTVSSA |
| 530 | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVKVSSA |
| 531 | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVQVSSA |

Figure 22 (continued)

| SEQ ID | Sequence |
|---|---|
| 532 | EVQLLESGGGVVQPGGSLRLSCAASGRIFSLPASGNIFNLLTIAWYRQAPGKGREL VATINSGSRTYYADSVKGRFTISRDNSKKTVYLQMNSLRPEDTALYYCQTSGSGS PNFWGQGTLVKVSSGGGGSGGGSEVQLVESGGGVVQPGNSLRLSCAASGFTFSS FGMSWVRQAPGKGLEWVSSISGSGSDTLYADSVKGRFTISRDNAKTTLYLQMNS LRPEDTALYYCTIGGSLSRSSQGTLVKVSSGGGGSGGGSEVQLLESGGGVVQPGG SLRLSCAASGRTLSSYAMGWFRQAPGKGREFVARISQGGTAIYYADSVKGRFTIS RDNSKNTLYLQMNSLRPEDTALYYCAKDPSPYYRGSAYLLSGSYDSWGQGTLV TVSSA |
| 533 | EVQLLESGGGVVQPGGSLRLSCAASGRIFSLPASGNIFNLLTIAWYRQAPGKGREL VATINSGSRTYYADSVKGRFTISRDNSKKTVYLQMNSLRPEDTALYYCQTSGSGS PNFWGQGTLVKVSSGGGGSGGGSEVQLVESGGGVVQPGNSLRLSCAASGFTFSS FGMSWVRQAPGKGLEWVSSISGSGSDTLYADSVKGRFTISRDNAKTTLYLQMNS LRPEDTALYYCTIGGSLSRSSQGTLVKVSSGGGGSGGGSEVQLLESGGGVVQPGG SLRLSCAASGRTLSSYAMGWFRQAPGKGREFVARISQGGTAIYYADSVKGRFTIS RDNSKNTLYLQMNSLRPEDTALYYCAKDPSPYYRGSAYLLSGSYDSWGQGTLV KVSSA |
| 534 | EVQLLESGGGVVQPGGSLRLSCAASGRIFSLPASGNIFNLLTIAWYRQAPGKGREL VATINSGSRTYYADSVKGRFTISRDNSKKTVYLQMNSLRPEDTALYYCQTSGSGS PNFWGQGTLVKVSSGGGGSGGGSEVQLVESGGGVVQPGNSLRLSCAASGFTFSS FGMSWVRQAPGKGLEWVSSISGSGSDTLYADSVKGRFTISRDNAKTTLYLQMNS LRPEDTALYYCTIGGSLSRSSQGTLVKVSSGGGGSGGGSEVQLLESGGGVVQPGG SLRLSCAASGRTLSSYAMGWFRQAPGKGREFVARISQGGTAIYYADSVKGRFTIS RDNSKNTLYLQMNSLRPEDTALYYCAKDPSPYYRGSAYLLSGSYDSWGQGTLV QVSSA |
| 535 | EVQLLESGGGVVQPGGSLRLSCAASGRIFSLPASGNIFNLLTIAWYRQAPGKGREL VATINSGSRTYYADSVKGRFTISRDNSKKTVYLQMNSLRPEDTALYYCQTSGSGS PNFWGQGTLVKVSSGGGGSGGGSEVQLVESGGGVVQPGNSLRLSCAASGFTFSS FGMSWVRQAPGKGLEWVSSISGSGSDTLYADSVKGRFTISRDNAKTTLYLQMNS LRPEDTALYYCTIGGSLSRSSQGTLVQVSSGGGGSGGGSEVQLLESGGGVVQPGG SLRLSCAASGRTLSSYAMGWFRQAPGKGREFVARISQGGTAIYYADSVKGRFTIS RDNSKNTLYLQMNSLRPEDTALYYCAKDPSPYYRGSAYLLSGSYDSWGQGTLV TVSSA |
| 536 | EVQLLESGGGVVQPGGSLRLSCAASGRIFSLPASGNIFNLLTIAWYRQAPGKGREL VATINSGSRTYYADSVKGRFTISRDNSKKTVYLQMNSLRPEDTALYYCQTSGSGS PNFWGQGTLVKVSSGGGGSGGGSEVQLVESGGGVVQPGNSLRLSCAASGFTFSS FGMSWVRQAPGKGLEWVSSISGSGSDTLYADSVKGRFTISRDNAKTTLYLQMNS LRPEDTALYYCTIGGSLSRSSQGTLVQVSSGGGGSGGGSEVQLLESGGGVVQPGG SLRLSCAASGRTLSSYAMGWFRQAPGKGREFVARISQGGTAIYYADSVKGRFTIS RDNSKNTLYLQMNSLRPEDTALYYCAKDPSPYYRGSAYLLSGSYDSWGQGTLV KVSSA |
| 537 | EVQLLESGGGVVQPGGSLRLSCAASGRIFSLPASGNIFNLLTIAWYRQAPGKGREL VATINSGSRTYYADSVKGRFTISRDNSKKTVYLQMNSLRPEDTALYYCQTSGSGS PNFWGQGTLVKVSSGGGGSGGGSEVQLVESGGGVVQPGNSLRLSCAASGFTFSS FGMSWVRQAPGKGLEWVSSISGSGSDTLYADSVKGRFTISRDNAKTTLYLQMNS LRPEDTALYYCTIGGSLSRSSQGTLVQVSSGGGGSGGGSEVQLLESGGGVVQPGG SLRLSCAASGRTLSSYAMGWFRQAPGKGREFVARISQGGTAIYYADSVKGRFTIS RDNSKNTLYLQMNSLRPEDTALYYCAKDPSPYYRGSAYLLSGSYDSWGQGTLV QVSSA |

Figure 22 (continued)

| SEQ ID | Sequence |
|---|---|
| 538 | EVQLLESGGGVVQPGGSLRLSCAASGRIFSLPASGNIFNLLTIAWYRQAPGKGREL VATINSGSRTYYADSVKGRFTISRDNSKKTVYLQMNSLRPEDTALYYCQTSGSGS PNFWGQGTLVQVSSGGGGSGGGSEVQLVESGGGLVQPGNSLRLSCAASGFTFSS FGMSWVRQAPGKGLEWVSSISGSGSDTLYADSVKGRFTISRDNAKTTLYLQMNS LRPEDTAVYYCTIGGSLSRSSQGTLVTVSSGGGGSGGGSEVQLLESGGGVVQPGG SLRLSCAASGRTLSSYAMGWFRQAPGKGREFVARISQGGTAIYYADSVKGRFTIS RDNSKNTLYLQMNSLRPEDTALYYCAKDPSPYYRGSAYLLSGSYDSWGQGTLV TVSSA |
| 539 | EVQLLESGGGVVQPGGSLRLSCAASGRIFSLPASGNIFNLLTIAWYRQAPGKGREL VATINSGSRTYYADSVKGRFTISRDNSKKTVYLQMNSLRPEDTALYYCQTSGSGS PNFWGQGTLVQVSSGGGGSGGGSEVQLVESGGGLVQPGNSLRLSCAASGFTFSS FGMSWVRQAPGKGLEWVSSISGSGSDTLYADSVKGRFTISRDNAKTTLYLQMNS LRPEDTAVYYCTIGGSLSRSSQGTLVTVSSGGGGSGGGSEVQLLESGGGVVQPGG SLRLSCAASGRTLSSYAMGWFRQAPGKGREFVARISQGGTAIYYADSVKGRFTIS RDNSKNTLYLQMNSLRPEDTALYYCAKDPSPYYRGSAYLLSGSYDSWGQGTLV KVSSA |
| 540 | EVQLLESGGGVVQPGGSLRLSCAASGRIFSLPASGNIFNLLTIAWYRQAPGKGREL VATINSGSRTYYADSVKGRFTISRDNSKKTVYLQMNSLRPEDTALYYCQTSGSGS PNFWGQGTLVQVSSGGGGSGGGSEVQLVESGGGLVQPGNSLRLSCAASGFTFSS FGMSWVRQAPGKGLEWVSSISGSGSDTLYADSVKGRFTISRDNAKTTLYLQMNS LRPEDTAVYYCTIGGSLSRSSQGTLVTVSSGGGGSGGGSEVQLLESGGGVVQPGG SLRLSCAASGRTLSSYAMGWFRQAPGKGREFVARISQGGTAIYYADSVKGRFTIS RDNSKNTLYLQMNSLRPEDTALYYCAKDPSPYYRGSAYLLSGSYDSWGQGTLV QVSSA |
| 541 | EVQLLESGGGVVQPGGSLRLSCAASGRIFSLPASGNIFNLLTIAWYRQAPGKGREL VATINSGSRTYYADSVKGRFTISRDNSKKTVYLQMNSLRPEDTALYYCQTSGSGS PNFWGQGTLVQVSSGGGGSGGGSEVQLVESGGGVVQPGNSLRLSCAASGFTFSS FGMSWVRQAPGKGLEWVSSISGSGSDTLYADSVKGRFTISRDNAKTTLYLQMNS LRPEDTALYYCTIGGSLSRSSQGTLVTVSSGGGGSGGGSEVQLLESGGGVVQPGG SLRLSCAASGRTLSSYAMGWFRQAPGKGREFVARISQGGTAIYYADSVKGRFTIS RDNSKNTLYLQMNSLRPEDTALYYCAKDPSPYYRGSAYLLSGSYDSWGQGTLV TVSSA |
| 542 | EVQLLESGGGVVQPGGSLRLSCAASGRIFSLPASGNIFNLLTIAWYRQAPGKGREL VATINSGSRTYYADSVKGRFTISRDNSKKTVYLQMNSLRPEDTALYYCQTSGSGS PNFWGQGTLVQVSSGGGGSGGGSEVQLVESGGGVVQPGNSLRLSCAASGFTFSS FGMSWVRQAPGKGLEWVSSISGSGSDTLYADSVKGRFTISRDNAKTTLYLQMNS LRPEDTALYYCTIGGSLSRSSQGTLVTVSSGGGGSGGGSEVQLLESGGGVVQPGG SLRLSCAASGRTLSSYAMGWFRQAPGKGREFVARISQGGTAIYYADSVKGRFTIS RDNSKNTLYLQMNSLRPEDTALYYCAKDPSPYYRGSAYLLSGSYDSWGQGTLV KVSSA |
| 543 | EVQLLESGGGVVQPGGSLRLSCAASGRIFSLPASGNIFNLLTIAWYRQAPGKGREL VATINSGSRTYYADSVKGRFTISRDNSKKTVYLQMNSLRPEDTALYYCQTSGSGS PNFWGQGTLVQVSSGGGGSGGGSEVQLVESGGGVVQPGNSLRLSCAASGFTFSS FGMSWVRQAPGKGLEWVSSISGSGSDTLYADSVKGRFTISRDNAKTTLYLQMNS LRPEDTALYYCTIGGSLSRSSQGTLVTVSSGGGGSGGGSEVQLLESGGGVVQPGG SLRLSCAASGRTLSSYAMGWFRQAPGKGREFVARISQGGTAIYYADSVKGRFTIS RDNSKNTLYLQMNSLRPEDTALYYCAKDPSPYYRGSAYLLSGSYDSWGQGTLV QVSSA |

Figure 22 (continued)

| SEQ ID | Sequence |
|---|---|
| 544 | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVTVSSA |
| 545 | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVKVSSA |
| 546 | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVQVSSA |
| 547 | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVTVSSA |
| 548 | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVKVSSA |
| 549 | EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVQVSSA |

Figure 23

| SEQ ID | Sequence |
|---|---|
| 550 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSA |
| 551 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSA |
| 552 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSA |
| 553 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSA |
| 554 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSA |

Figure 23 (continued)

| SEQ ID | Sequence |
|---|---|
| 555 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSA |
| 556 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSA |
| 557 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSA |
| 558 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSA |
| 559 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSA |

Figure 23 (continued)

| SEQ ID | Sequence |
|---|---|
| 560 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSA |
| 561 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSA |
| 562 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSA |
| 563 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSA |
| 564 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSA |

Figure 23 (continued)

| SEQ ID | Sequence |
|---|---|
| 565 | EVQLVESGGGVVQPGGSLRLSCAASRSIGRLDRMGWYRHRPGEPRELVATITGGSSI NYGDSVKGRFTISIDNSKNTVYLQMNSLRPEDTALYYCNFNKYVTSRDTWGQGTL VKVSSGGGGSGGGSEVQLVESGGGVVQPGNSLRLSCAASGFTFSSFGMSWVRQAP GKGLEWVSSISGSGSDTLYADSVKGRFTISRDNAKTTLYLQMNSLRPEDTALYYCTI GGSLSRSSQGTLVTVSSGGGGSGGGSEVQLVESGGGVVQPGGSLRLSCAASRSIGRL DRMGWYRHRPGEPRELVATITGGSSINYGDSVKGRFTISIDNSKNTVYLQMNSLRPE DTALYYCNFNKYVTSRDTWGQGTLVTVSSA |
| 566 | EVQLVESGGGVVQPGGSLRLSCAASRSIGRLDRMGWYRHRPGEPRELVATITGGSSI NYGDSVKGRFTISIDNSKNTVYLQMNSLRPEDTALYYCNFNKYVTSRDTWGQGTL VKVSSGGGGSGGGSEVQLVESGGGVVQPGNSLRLSCAASGFTFSSFGMSWVRQAP GKGLEWVSSISGSGSDTLYADSVKGRFTISRDNAKTTLYLQMNSLRPEDTALYYCTI GGSLSRSSQGTLVTVSSGGGGSGGGSEVQLVESGGGVVQPGGSLRLSCAASRSIGRL DRMGWYRHRPGEPRELVATITGGSSINYGDSVKGRFTISIDNSKNTVYLQMNSLRPE DTALYYCNFNKYVTSRDTWGQGTLVKVSSA |
| 567 | EVQLVESGGGVVQPGGSLRLSCAASRSIGRLDRMGWYRHRPGEPRELVATITGGSSI NYGDSVKGRFTISIDNSKNTVYLQMNSLRPEDTALYYCNFNKYVTSRDTWGQGTL VKVSSGGGGSGGGSEVQLVESGGGVVQPGNSLRLSCAASGFTFSSFGMSWVRQAP GKGLEWVSSISGSGSDTLYADSVKGRFTISRDNAKTTLYLQMNSLRPEDTALYYCTI GGSLSRSSQGTLVTVSSGGGGSGGGSEVQLVESGGGVVQPGGSLRLSCAASRSIGRL DRMGWYRHRPGEPRELVATITGGSSINYGDSVKGRFTISIDNSKNTVYLQMNSLRPE DTALYYCNFNKYVTSRDTWGQGTLVQVSSA |
| 568 | EVQLVESGGGVVQPGGSLRLSCAASRSIGRLDRMGWYRHRPGEPRELVATITGGSSI NYGDSVKGRFTISIDNSKNTVYLQMNSLRPEDTALYYCNFNKYVTSRDTWGQGTL VKVSSGGGGSGGGSEVQLVESGGGVVQPGNSLRLSCAASGFTFSSFGMSWVRQAP GKGLEWVSSISGSGSDTLYADSVKGRFTISRDNAKTTLYLQMNSLRPEDTALYYCTI GGSLSRSSQGTLVKVSSGGGGSGGGSEVQLVESGGGVVQPGGSLRLSCAASRSIGR LDRMGWYRHRPGEPRELVATITGGSSINYGDSVKGRFTISIDNSKNTVYLQMNSLRP EDTALYYCNFNKYVTSRDTWGQGTLVTVSSA |
| 569 | EVQLVESGGGVVQPGGSLRLSCAASRSIGRLDRMGWYRHRPGEPRELVATITGGSSI NYGDSVKGRFTISIDNSKNTVYLQMNSLRPEDTALYYCNFNKYVTSRDTWGQGTL VKVSSGGGGSGGGSEVQLVESGGGVVQPGNSLRLSCAASGFTFSSFGMSWVRQAP GKGLEWVSSISGSGSDTLYADSVKGRFTISRDNAKTTLYLQMNSLRPEDTALYYCTI GGSLSRSSQGTLVKVSSGGGGSGGGSEVQLVESGGGVVQPGGSLRLSCAASRSIGR LDRMGWYRHRPGEPRELVATITGGSSINYGDSVKGRFTISIDNSKNTVYLQMNSLRP EDTALYYCNFNKYVTSRDTWGQGTLVKVSSA |

Figure 23 (continued)

| SEQ ID | Sequence |
|---|---|
| 570 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSA |
| 571 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSA |
| 572 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSA |
| 573 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSA |
| 574 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSA |

Figure 23 (continued)

| SEQ ID | Sequence |
|---|---|
| 575 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSA |
| 576 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSA |
| 577 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSA |
| 578 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSA |
| 579 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSA |

Figure 23 (continued)

| SEQ ID | Sequence |
|---|---|
| 580 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSA |
| 581 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSA |
| 582 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSA |
| 583 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSA |
| 584 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSA |
| 585 | EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSA |

Figure 24

| SEQ ID | Sequence |
| --- | --- |
| 586 | DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVTVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSA |
| 587 | DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVTVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSA |
| 588 | DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVTVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVQVSSA |
| 589 | DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVKVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSA |
| 590 | DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVKVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSA |
| 591 | DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVKVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVQVSSA |
| 592 | DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVQVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSA |
| 593 | DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVQVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSA |
| 594 | DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVQVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVQVSSA |

Figure 25

| SEQ ID | Sequence |
|---|---|
| 595 | EVQLVESGGGVVQPGGSLRLSCAASGFTFSSYAMSWVRQAPGKGLEWVSGIKSSG DSTRYAGSVKGRFTISRDNAKNTLYLQMNSLRPEDTALYYCAKSRVSRTGLYTYD NRGQGTLVTVSSGGGGSGGGGSGGGGSGGGGSEVQLVESGGGVVQPGGSLRLSC AASGRTFNNYAMGWFRQAPGKEREFVAAITRSGVRSGVSAIYGDSVKDRFTISRD NAKNTLYLQMNSLRPEDTALYYCAASAIGSGALRRFEYDYSGQGTLVTVSSA |
| 596 | EVQLVESGGGVVQPGGSLRLSCAASGFTFSSYAMSWVRQAPGKGLEWVSGIKSSG DSTRYAGSVKGRFTISRDNAKNTLYLQMNSLRPEDTALYYCAKSRVSRTGLYTYD NRGQGTLVTVSSGGGGSGGGGSGGGGSGGGGSEVQLVESGGGVVQPGGSLRLSC AASGRTFNNYAMGWFRQAPGKEREFVAAITRSGVRSGVSAIYGDSVKDRFTISRD NAKNTLYLQMNSLRPEDTALYYCAASAIGSGALRRFEYDYSGQGTLVKVSSA |
| 597 | EVQLVESGGGVVQPGGSLRLSCAASGFTFSSYAMSWVRQAPGKGLEWVSGIKSSG DSTRYAGSVKGRFTISRDNAKNTLYLQMNSLRPEDTALYYCAKSRVSRTGLYTYD NRGQGTLVTVSSGGGGSGGGGSGGGGSGGGGSEVQLVESGGGVVQPGGSLRLSC AASGRTFNNYAMGWFRQAPGKEREFVAAITRSGVRSGVSAIYGDSVKDRFTISRD NAKNTLYLQMNSLRPEDTALYYCAASAIGSGALRRFEYDYSGQGTLVQVSSA |
| 598 | EVQLVESGGGVVQPGGSLRLSCAASGFTFSSYAMSWVRQAPGKGLEWVSGIKSSG DSTRYAGSVKGRFTISRDNAKNTLYLQMNSLRPEDTALYYCAKSRVSRTGLYTYD NRGQGTLVKVSSGGGGSGGGGSGGGGSGGGGSEVQLVESGGGVVQPGGSLRLSC AASGRTFNNYAMGWFRQAPGKEREFVAAITRSGVRSGVSAIYGDSVKDRFTISRD NAKNTLYLQMNSLRPEDTALYYCAASAIGSGALRRFEYDYSGQGTLVTVSSA |
| 599 | EVQLVESGGGVVQPGGSLRLSCAASGFTFSSYAMSWVRQAPGKGLEWVSGIKSSG DSTRYAGSVKGRFTISRDNAKNTLYLQMNSLRPEDTALYYCAKSRVSRTGLYTYD NRGQGTLVKVSSGGGGSGGGGSGGGGSGGGGSEVQLVESGGGVVQPGGSLRLSC AASGRTFNNYAMGWFRQAPGKEREFVAAITRSGVRSGVSAIYGDSVKDRFTISRD NAKNTLYLQMNSLRPEDTALYYCAASAIGSGALRRFEYDYSGQGTLVKVSSA |
| 600 | EVQLVESGGGVVQPGGSLRLSCAASGFTFSSYAMSWVRQAPGKGLEWVSGIKSSG DSTRYAGSVKGRFTISRDNAKNTLYLQMNSLRPEDTALYYCAKSRVSRTGLYTYD NRGQGTLVKVSSGGGGSGGGGSGGGGSGGGGSEVQLVESGGGVVQPGGSLRLSC AASGRTFNNYAMGWFRQAPGKEREFVAAITRSGVRSGVSAIYGDSVKDRFTISRD NAKNTLYLQMNSLRPEDTALYYCAASAIGSGALRRFEYDYSGQGTLVQVSSA |
| 601 | EVQLVESGGGVVQPGGSLRLSCAASGFTFSSYAMSWVRQAPGKGLEWVSGIKSSG DSTRYAGSVKGRFTISRDNAKNTLYLQMNSLRPEDTALYYCAKSRVSRTGLYTYD NRGQGTLVQVSSGGGGSGGGGSGGGGSGGGGSEVQLVESGGGVVQPGGSLRLSC AASGRTFNNYAMGWFRQAPGKEREFVAAITRSGVRSGVSAIYGDSVKDRFTISRD NAKNTLYLQMNSLRPEDTALYYCAASAIGSGALRRFEYDYSGQGTLVTVSSA |
| 602 | EVQLVESGGGVVQPGGSLRLSCAASGFTFSSYAMSWVRQAPGKGLEWVSGIKSSG DSTRYAGSVKGRFTISRDNAKNTLYLQMNSLRPEDTALYYCAKSRVSRTGLYTYD NRGQGTLVQVSSGGGGSGGGGSGGGGSGGGGSEVQLVESGGGVVQPGGSLRLSC AASGRTFNNYAMGWFRQAPGKEREFVAAITRSGVRSGVSAIYGDSVKDRFTISRD NAKNTLYLQMNSLRPEDTALYYCAASAIGSGALRRFEYDYSGQGTLVKVSSA |
| 603 | EVQLVESGGGVVQPGGSLRLSCAASGFTFSSYAMSWVRQAPGKGLEWVSGIKSSG DSTRYAGSVKGRFTISRDNAKNTLYLQMNSLRPEDTALYYCAKSRVSRTGLYTYD NRGQGTLVQVSSGGGGSGGGGSGGGGSGGGGSEVQLVESGGGVVQPGGSLRLSC AASGRTFNNYAMGWFRQAPGKEREFVAAITRSGVRSGVSAIYGDSVKDRFTISRD NAKNTLYLQMNSLRPEDTALYYCAASAIGSGALRRFEYDYSGQGTLVQVSSA |

Figure 26

| SEQ ID | Sequence |
|---|---|
| 604 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVTVSSGGGGSGGGSEVQLVESGGGLVQPGNSLRLSCAASGFTFSSFGM SWVRQAPGKGLEWVSSISGSGSDTLYADSVKGRFTISRDNAKTTLYLQMNSLRPE DTAVYYCTIGGSLSRSSQGTLVTVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVTVSSA |
| 605 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVTVSSGGGGSGGGSEVQLVESGGGLVQPGNSLRLSCAASGFTFSSFGM SWVRQAPGKGLEWVSSISGSGSDTLYADSVKGRFTISRDNAKTTLYLQMNSLRPE DTAVYYCTIGGSLSRSSQGTLVTVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVKVSSA |
| 606 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVTVSSGGGGSGGGSEVQLVESGGGLVQPGNSLRLSCAASGFTFSSFGM SWVRQAPGKGLEWVSSISGSGSDTLYADSVKGRFTISRDNAKTTLYLQMNSLRPE DTAVYYCTIGGSLSRSSQGTLVTVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVQVSSA |
| 607 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVTVSSGGGGSGGGSEVQLVESGGGVVQPGNSLRLSCAASGFTFSSFGM SWVRQAPGKGLEWVSSISGSGSDTLYADSVKGRFTISRDNAKTTLYLQMNSLRPE DTALYYCTIGGSLSRSSQGTLVTVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVTVSSA |
| 608 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVTVSSGGGGSGGGSEVQLVESGGGVVQPGNSLRLSCAASGFTFSSFGM SWVRQAPGKGLEWVSSISGSGSDTLYADSVKGRFTISRDNAKTTLYLQMNSLRPE DTALYYCTIGGSLSRSSQGTLVTVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVKVSSA |
| 609 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVTVSSGGGGSGGGSEVQLVESGGGVVQPGNSLRLSCAASGFTFSSFGM SWVRQAPGKGLEWVSSISGSGSDTLYADSVKGRFTISRDNAKTTLYLQMNSLRPE DTALYYCTIGGSLSRSSQGTLVTVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVQVSSA |

Figure 26 (continued)

| SEQ ID | Sequence |
|---|---|
| 610 | DVQLVESGGGVVQPGGSLRLSCAASGSIGGLNAMAWYRQAPGKERELVAGIFG<br>VGSTRYADSVKGRFTISRDNSKNTVYLQMNSLRPEDTALYYCRMSSVTRGSSDY<br>WGQGTLVTVSSGGGGSGGGSEVQLVESGGGVVQPGNSLRLSCAASGFTFSSFGM<br>SWVRQAPGKGLEWVSSISGSGSDTLYADSVKGRFTISRDNAKTTLYLQMNSLRPE<br>DTALYYCTIGGSLSRSSQGTLVKVSSGGGGSGGGSEVQLVESGGGVVQPGGSLRL<br>SCAASGRTYYLNAMGWFRQAPGKEREFVAAIDWSEGNKDYADSVKGRFTISRD<br>NSKNTVYLQMNSLRPEDTALYYCAADTPPWGPLIYIESYDSWGQGTLVTVSSA |
| 611 | DVQLVESGGGVVQPGGSLRLSCAASGSIGGLNAMAWYRQAPGKERELVAGIFG<br>VGSTRYADSVKGRFTISRDNSKNTVYLQMNSLRPEDTALYYCRMSSVTRGSSDY<br>WGQGTLVTVSSGGGGSGGGSEVQLVESGGGVVQPGNSLRLSCAASGFTFSSFGM<br>SWVRQAPGKGLEWVSSISGSGSDTLYADSVKGRFTISRDNAKTTLYLQMNSLRPE<br>DTALYYCTIGGSLSRSSQGTLVKVSSGGGGSGGGSEVQLVESGGGVVQPGGSLRL<br>SCAASGRTYYLNAMGWFRQAPGKEREFVAAIDWSEGNKDYADSVKGRFTISRD<br>NSKNTVYLQMNSLRPEDTALYYCAADTPPWGPLIYIESYDSWGQGTLVKVSSA |
| 612 | DVQLVESGGGVVQPGGSLRLSCAASGSIGGLNAMAWYRQAPGKERELVAGIFG<br>VGSTRYADSVKGRFTISRDNSKNTVYLQMNSLRPEDTALYYCRMSSVTRGSSDY<br>WGQGTLVTVSSGGGGSGGGSEVQLVESGGGVVQPGNSLRLSCAASGFTFSSFGM<br>SWVRQAPGKGLEWVSSISGSGSDTLYADSVKGRFTISRDNAKTTLYLQMNSLRPE<br>DTALYYCTIGGSLSRSSQGTLVKVSSGGGGSGGGSEVQLVESGGGVVQPGGSLRL<br>SCAASGRTYYLNAMGWFRQAPGKEREFVAAIDWSEGNKDYADSVKGRFTISRD<br>NSKNTVYLQMNSLRPEDTALYYCAADTPPWGPLIYIESYDSWGQGTLVQVSSA |
| 613 | DVQLVESGGGVVQPGGSLRLSCAASGSIGGLNAMAWYRQAPGKERELVAGIFG<br>VGSTRYADSVKGRFTISRDNSKNTVYLQMNSLRPEDTALYYCRMSSVTRGSSDY<br>WGQGTLVTVSSGGGGSGGGSEVQLVESGGGVVQPGNSLRLSCAASGFTFSSFGM<br>SWVRQAPGKGLEWVSSISGSGSDTLYADSVKGRFTISRDNAKTTLYLQMNSLRPE<br>DTALYYCTIGGSLSRSSQGTLVQVSSGGGGSGGGSEVQLVESGGGVVQPGGSLRL<br>SCAASGRTYYLNAMGWFRQAPGKEREFVAAIDWSEGNKDYADSVKGRFTISRD<br>NSKNTVYLQMNSLRPEDTALYYCAADTPPWGPLIYIESYDSWGQGTLVTVSSA |
| 614 | DVQLVESGGGVVQPGGSLRLSCAASGSIGGLNAMAWYRQAPGKERELVAGIFG<br>VGSTRYADSVKGRFTISRDNSKNTVYLQMNSLRPEDTALYYCRMSSVTRGSSDY<br>WGQGTLVTVSSGGGGSGGGSEVQLVESGGGVVQPGNSLRLSCAASGFTFSSFGM<br>SWVRQAPGKGLEWVSSISGSGSDTLYADSVKGRFTISRDNAKTTLYLQMNSLRPE<br>DTALYYCTIGGSLSRSSQGTLVQVSSGGGGSGGGSEVQLVESGGGVVQPGGSLRL<br>SCAASGRTYYLNAMGWFRQAPGKEREFVAAIDWSEGNKDYADSVKGRFTISRD<br>NSKNTVYLQMNSLRPEDTALYYCAADTPPWGPLIYIESYDSWGQGTLVKVSSA |
| 615 | DVQLVESGGGVVQPGGSLRLSCAASGSIGGLNAMAWYRQAPGKERELVAGIFG<br>VGSTRYADSVKGRFTISRDNSKNTVYLQMNSLRPEDTALYYCRMSSVTRGSSDY<br>WGQGTLVTVSSGGGGSGGGSEVQLVESGGGVVQPGNSLRLSCAASGFTFSSFGM<br>SWVRQAPGKGLEWVSSISGSGSDTLYADSVKGRFTISRDNAKTTLYLQMNSLRPE<br>DTALYYCTIGGSLSRSSQGTLVQVSSGGGGSGGGSEVQLVESGGGVVQPGGSLRL<br>SCAASGRTYYLNAMGWFRQAPGKEREFVAAIDWSEGNKDYADSVKGRFTISRD<br>NSKNTVYLQMNSLRPEDTALYYCAADTPPWGPLIYIESYDSWGQGTLVQVSSA |

Figure 26 (continued)

| SEQ ID | Sequence |
|---|---|
| 616 | DVQLVESGGGVVQPGGSLRLSCAASGSIGGLNAMAWYRQAPGKERELVAGIFG<br>VGSTRYADSVKGRFTISRDNSKNTVYLQMNSLRPEDTALYYCRMSSVTRGSSDY<br>WGQGTLVKVSSGGGGSGGGSEVQLVESGGGLVQPGNSLRLSCAASGFTFSSFGM<br>SWVRQAPGKGLEWVSSISGSGSDTLYADSVKGRFTISRDNAKTTLYLQMNSLRPE<br>DTAVYYCTIGGSLSRSSQGTLVTVSSGGGGSGGGSEVQLVESGGGVVQPGGSLRL<br>SCAASGRTYYLNAMGWFRQAPGKEREFVAAIDWSEGNKDYADSVKGRFTISRD<br>NSKNTVYLQMNSLRPEDTALYYCAADTPPWGPLIYIESYDSWGQGTLVTVSSA |
| 617 | DVQLVESGGGVVQPGGSLRLSCAASGSIGGLNAMAWYRQAPGKERELVAGIFG<br>VGSTRYADSVKGRFTISRDNSKNTVYLQMNSLRPEDTALYYCRMSSVTRGSSDY<br>WGQGTLVKVSSGGGGSGGGSEVQLVESGGGLVQPGNSLRLSCAASGFTFSSFGM<br>SWVRQAPGKGLEWVSSISGSGSDTLYADSVKGRFTISRDNAKTTLYLQMNSLRPE<br>DTAVYYCTIGGSLSRSSQGTLVTVSSGGGGSGGGSEVQLVESGGGVVQPGGSLRL<br>SCAASGRTYYLNAMGWFRQAPGKEREFVAAIDWSEGNKDYADSVKGRFTISRD<br>NSKNTVYLQMNSLRPEDTALYYCAADTPPWGPLIYIESYDSWGQGTLVKVSSA |
| 618 | DVQLVESGGGVVQPGGSLRLSCAASGSIGGLNAMAWYRQAPGKERELVAGIFG<br>VGSTRYADSVKGRFTISRDNSKNTVYLQMNSLRPEDTALYYCRMSSVTRGSSDY<br>WGQGTLVKVSSGGGGSGGGSEVQLVESGGGLVQPGNSLRLSCAASGFTFSSFGM<br>SWVRQAPGKGLEWVSSISGSGSDTLYADSVKGRFTISRDNAKTTLYLQMNSLRPE<br>DTAVYYCTIGGSLSRSSQGTLVTVSSGGGGSGGGSEVQLVESGGGVVQPGGSLRL<br>SCAASGRTYYLNAMGWFRQAPGKEREFVAAIDWSEGNKDYADSVKGRFTISRD<br>NSKNTVYLQMNSLRPEDTALYYCAADTPPWGPLIYIESYDSWGQGTLVQVSSA |
| 619 | DVQLVESGGGVVQPGGSLRLSCAASGSIGGLNAMAWYRQAPGKERELVAGIFG<br>VGSTRYADSVKGRFTISRDNSKNTVYLQMNSLRPEDTALYYCRMSSVTRGSSDY<br>WGQGTLVKVSSGGGGSGGGSEVQLVESGGGVVQPGNSLRLSCAASGFTFSSFGM<br>SWVRQAPGKGLEWVSSISGSGSDTLYADSVKGRFTISRDNAKTTLYLQMNSLRPE<br>DTALYYCTIGGSLSRSSQGTLVTVSSGGGGSGGGSEVQLVESGGGVVQPGGSLRL<br>SCAASGRTYYLNAMGWFRQAPGKEREFVAAIDWSEGNKDYADSVKGRFTISRD<br>NSKNTVYLQMNSLRPEDTALYYCAADTPPWGPLIYIESYDSWGQGTLVTVSSA |
| 620 | DVQLVESGGGVVQPGGSLRLSCAASGSIGGLNAMAWYRQAPGKERELVAGIFG<br>VGSTRYADSVKGRFTISRDNSKNTVYLQMNSLRPEDTALYYCRMSSVTRGSSDY<br>WGQGTLVKVSSGGGGSGGGSEVQLVESGGGVVQPGNSLRLSCAASGFTFSSFGM<br>SWVRQAPGKGLEWVSSISGSGSDTLYADSVKGRFTISRDNAKTTLYLQMNSLRPE<br>DTALYYCTIGGSLSRSSQGTLVTVSSGGGGSGGGSEVQLVESGGGVVQPGGSLRL<br>SCAASGRTYYLNAMGWFRQAPGKEREFVAAIDWSEGNKDYADSVKGRFTISRD<br>NSKNTVYLQMNSLRPEDTALYYCAADTPPWGPLIYIESYDSWGQGTLVKVSSA |
| 621 | DVQLVESGGGVVQPGGSLRLSCAASGSIGGLNAMAWYRQAPGKERELVAGIFG<br>VGSTRYADSVKGRFTISRDNSKNTVYLQMNSLRPEDTALYYCRMSSVTRGSSDY<br>WGQGTLVKVSSGGGGSGGGSEVQLVESGGGVVQPGNSLRLSCAASGFTFSSFGM<br>SWVRQAPGKGLEWVSSISGSGSDTLYADSVKGRFTISRDNAKTTLYLQMNSLRPE<br>DTALYYCTIGGSLSRSSQGTLVTVSSGGGGSGGGSEVQLVESGGGVVQPGGSLRL<br>SCAASGRTYYLNAMGWFRQAPGKEREFVAAIDWSEGNKDYADSVKGRFTISRD<br>NSKNTVYLQMNSLRPEDTALYYCAADTPPWGPLIYIESYDSWGQGTLVQVSSA |

Figure 26 (continued)

| SEQ ID | Sequence |
|---|---|
| 622 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVKVSSGGGGSGGGSEVQLVESGGGVVQPGNSLRLSCAASGFTFSSFGM SWVRQAPGKGLEWVSSISGSGSDTLYADSVKGRFTISRDNAKTTLYLQMNSLRPE DTALYYCTIGGSLSRSSQGTLVKVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVTVSSA |
| 623 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVKVSSGGGGSGGGSEVQLVESGGGVVQPGNSLRLSCAASGFTFSSFGM SWVRQAPGKGLEWVSSISGSGSDTLYADSVKGRFTISRDNAKTTLYLQMNSLRPE DTALYYCTIGGSLSRSSQGTLVKVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVKVSSA |
| 624 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVKVSSGGGGSGGGSEVQLVESGGGVVQPGNSLRLSCAASGFTFSSFGM SWVRQAPGKGLEWVSSISGSGSDTLYADSVKGRFTISRDNAKTTLYLQMNSLRPE DTALYYCTIGGSLSRSSQGTLVKVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVQVSSA |
| 625 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVKVSSGGGGSGGGSEVQLVESGGGVVQPGNSLRLSCAASGFTFSSFGM SWVRQAPGKGLEWVSSISGSGSDTLYADSVKGRFTISRDNAKTTLYLQMNSLRPE DTALYYCTIGGSLSRSSQGTLVQVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVTVSSA |
| 626 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVKVSSGGGGSGGGSEVQLVESGGGVVQPGNSLRLSCAASGFTFSSFGM SWVRQAPGKGLEWVSSISGSGSDTLYADSVKGRFTISRDNAKTTLYLQMNSLRPE DTALYYCTIGGSLSRSSQGTLVQVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVKVSSA |
| 627 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVKVSSGGGGSGGGSEVQLVESGGGVVQPGNSLRLSCAASGFTFSSFGM SWVRQAPGKGLEWVSSISGSGSDTLYADSVKGRFTISRDNAKTTLYLQMNSLRPE DTALYYCTIGGSLSRSSQGTLVQVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVQVSSA |

Figure 26 (continued)

| SEQ ID | Sequence |
|---|---|
| 628 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVQVSSGGGGSGGGSEVQLVESGGGLVQPGNSLRLSCAASGFTFSSFGM SWVRQAPGKGLEWVSSISGSGSDTLYADSVKGRFTISRDNAKTTLYLQMNSLRPE DTAVYYCTIGGSLSRSSQGTLVTVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVTVSSA |
| 629 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVQVSSGGGGSGGGSEVQLVESGGGLVQPGNSLRLSCAASGFTFSSFGM SWVRQAPGKGLEWVSSISGSGSDTLYADSVKGRFTISRDNAKTTLYLQMNSLRPE DTAVYYCTIGGSLSRSSQGTLVTVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVKVSSA |
| 630 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVQVSSGGGGSGGGSEVQLVESGGGLVQPGNSLRLSCAASGFTFSSFGM SWVRQAPGKGLEWVSSISGSGSDTLYADSVKGRFTISRDNAKTTLYLQMNSLRPE DTAVYYCTIGGSLSRSSQGTLVTVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVQVSSA |
| 631 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVQVSSGGGGSGGGSEVQLVESGGGVVQPGNSLRLSCAASGFTFSSFGM SWVRQAPGKGLEWVSSISGSGSDTLYADSVKGRFTISRDNAKTTLYLQMNSLRPE DTALYYCTIGGSLSRSSQGTLVTVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVTVSSA |
| 632 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVQVSSGGGGSGGGSEVQLVESGGGVVQPGNSLRLSCAASGFTFSSFGM SWVRQAPGKGLEWVSSISGSGSDTLYADSVKGRFTISRDNAKTTLYLQMNSLRPE DTALYYCTIGGSLSRSSQGTLVTVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVKVSSA |
| 633 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVQVSSGGGGSGGGSEVQLVESGGGVVQPGNSLRLSCAASGFTFSSFGM SWVRQAPGKGLEWVSSISGSGSDTLYADSVKGRFTISRDNAKTTLYLQMNSLRPE DTALYYCTIGGSLSRSSQGTLVTVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVQVSSA |

Figure 26 (continued)

| SEQ ID | Sequence |
|---|---|
| 634 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVQVSSGGGGSGGGSEVQLVESGGGVVQPGNSLRLSCAASGFTFSSFGM SWVRQAPGKGLEWVSSISGSGSDTLYADSVKGRFTISRDNAKTTLYLQMNSLRPE DTALYYCTIGGSLSRSSQGTLVKVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVTVSSA |
| 635 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVQVSSGGGGSGGGSEVQLVESGGGVVQPGNSLRLSCAASGFTFSSFGM SWVRQAPGKGLEWVSSISGSGSDTLYADSVKGRFTISRDNAKTTLYLQMNSLRPE DTALYYCTIGGSLSRSSQGTLVKVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVKVSSA |
| 636 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVQVSSGGGGSGGGSEVQLVESGGGVVQPGNSLRLSCAASGFTFSSFGM SWVRQAPGKGLEWVSSISGSGSDTLYADSVKGRFTISRDNAKTTLYLQMNSLRPE DTALYYCTIGGSLSRSSQGTLVKVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVQVSSA |
| 637 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVQVSSGGGGSGGGSEVQLVESGGGVVQPGNSLRLSCAASGFTFSSFGM SWVRQAPGKGLEWVSSISGSGSDTLYADSVKGRFTISRDNAKTTLYLQMNSLRPE DTALYYCTIGGSLSRSSQGTLVQVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVTVSSA |
| 638 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVQVSSGGGGSGGGSEVQLVESGGGVVQPGNSLRLSCAASGFTFSSFGM SWVRQAPGKGLEWVSSISGSGSDTLYADSVKGRFTISRDNAKTTLYLQMNSLRPE DTALYYCTIGGSLSRSSQGTLVQVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVKVSSA |
| 639 | DVQLVESGGGVVQPGGSLRLSCAASGSIGGLNAMAWYRQAPGKERELVAGIFG VGSTRYADSVKGRFTISRDNSKNTVYLQMNSLRPEDTALYYCRMSSVTRGSSDY WGQGTLVQVSSGGGGSGGGSEVQLVESGGGVVQPGNSLRLSCAASGFTFSSFGM SWVRQAPGKGLEWVSSISGSGSDTLYADSVKGRFTISRDNAKTTLYLQMNSLRPE DTALYYCTIGGSLSRSSQGTLVQVSSGGGGSGGGSEVQLVESGGGVVQPGGSLRL SCAASGRTYYLNAMGWFRQAPGKEREFVAAIDWSEGNKDYADSVKGRFTISRD NSKNTVYLQMNSLRPEDTALYYCAADTPPWGPLIYIESYDSWGQGTLVQVSSA |

Figure 27

| SEQ ID | Sequence |
|---|---|
| 640 | EVQLVESGGGVVQPGGSLRLSCAASGFTFSDYWMYWVRQAPGKGLEWVSEINT NGLITKYPDSVKGRFTISRDNAKNTLYLQMNSLRPEDTALYYCARSPSGFNRGQG TLVTVSSGGGGSGGGSEVQLVESGGGLVQPGNSLRLSCAASGFTFSSFGMSWVR QAPGKGLEWVSSISGSGSDTLYADSVKGRFTISRDNAKTTLYLQMNSLRPEDTAV YYCTIGGSLSRSSQGTLVTVSSGGGGSGGGSEVQLVESGGGVVQPGGSLRLSCAA SGFTFSDYWMYWVRQAPGKGLEWVSEINTNGLITKYPDSVKGRFTISRDNAKNT LYLQMNSLRPEDTALYYCARSPSGFNRGQGTLVTVSSA |
| 641 | EVQLVESGGGVVQPGGSLRLSCAASGFTFSDYWMYWVRQAPGKGLEWVSEINT NGLITKYPDSVKGRFTISRDNAKNTLYLQMNSLRPEDTALYYCARSPSGFNRGQG TLVTVSSGGGGSGGGSEVQLVESGGGLVQPGNSLRLSCAASGFTFSSFGMSWVR QAPGKGLEWVSSISGSGSDTLYADSVKGRFTISRDNAKTTLYLQMNSLRPEDTAV YYCTIGGSLSRSSQGTLVTVSSGGGGSGGGSEVQLVESGGGVVQPGGSLRLSCAA SGFTFSDYWMYWVRQAPGKGLEWVSEINTNGLITKYPDSVKGRFTISRDNAKNT LYLQMNSLRPEDTALYYCARSPSGFNRGQGTLVKVSSA |
| 642 | EVQLVESGGGVVQPGGSLRLSCAASGFTFSDYWMYWVRQAPGKGLEWVSEINT NGLITKYPDSVKGRFTISRDNAKNTLYLQMNSLRPEDTALYYCARSPSGFNRGQG TLVTVSSGGGGSGGGSEVQLVESGGGLVQPGNSLRLSCAASGFTFSSFGMSWVR QAPGKGLEWVSSISGSGSDTLYADSVKGRFTISRDNAKTTLYLQMNSLRPEDTAV YYCTIGGSLSRSSQGTLVTVSSGGGGSGGGSEVQLVESGGGVVQPGGSLRLSCAA SGFTFSDYWMYWVRQAPGKGLEWVSEINTNGLITKYPDSVKGRFTISRDNAKNT LYLQMNSLRPEDTALYYCARSPSGFNRGQGTLVQVSSA |
| 643 | EVQLVESGGGVVQPGGSLRLSCAASGFTFSDYWMYWVRQAPGKGLEWVSEINT NGLITKYPDSVKGRFTISRDNAKNTLYLQMNSLRPEDTALYYCARSPSGFNRGQG TLVTVSSGGGGSGGGSEVQLVESGGGVVQPGNSLRLSCAASGFTFSSFGMSWVR QAPGKGLEWVSSISGSGSDTLYADSVKGRFTISRDNAKTTLYLQMNSLRPEDTAL YYCTIGGSLSRSSQGTLVTVSSGGGGSGGGSEVQLVESGGGVVQPGGSLRLSCAA SGFTFSDYWMYWVRQAPGKGLEWVSEINTNGLITKYPDSVKGRFTISRDNAKNT LYLQMNSLRPEDTALYYCARSPSGFNRGQGTLVTVSSA |
| 644 | EVQLVESGGGVVQPGGSLRLSCAASGFTFSDYWMYWVRQAPGKGLEWVSEINT NGLITKYPDSVKGRFTISRDNAKNTLYLQMNSLRPEDTALYYCARSPSGFNRGQG TLVTVSSGGGGSGGGSEVQLVESGGGVVQPGNSLRLSCAASGFTFSSFGMSWVR QAPGKGLEWVSSISGSGSDTLYADSVKGRFTISRDNAKTTLYLQMNSLRPEDTAL YYCTIGGSLSRSSQGTLVTVSSGGGGSGGGSEVQLVESGGGVVQPGGSLRLSCAA SGFTFSDYWMYWVRQAPGKGLEWVSEINTNGLITKYPDSVKGRFTISRDNAKNT LYLQMNSLRPEDTALYYCARSPSGFNRGQGTLVKVSSA |
| 645 | EVQLVESGGGVVQPGGSLRLSCAASGFTFSDYWMYWVRQAPGKGLEWVSEINT NGLITKYPDSVKGRFTISRDNAKNTLYLQMNSLRPEDTALYYCARSPSGFNRGQG TLVTVSSGGGGSGGGSEVQLVESGGGVVQPGNSLRLSCAASGFTFSSFGMSWVR QAPGKGLEWVSSISGSGSDTLYADSVKGRFTISRDNAKTTLYLQMNSLRPEDTAL YYCTIGGSLSRSSQGTLVTVSSGGGGSGGGSEVQLVESGGGVVQPGGSLRLSCAA SGFTFSDYWMYWVRQAPGKGLEWVSEINTNGLITKYPDSVKGRFTISRDNAKNT LYLQMNSLRPEDTALYYCARSPSGFNRGQGTLVQVSSA |

Figure 27 (continued)

| SEQ ID | Sequence |
|---|---|
| 646 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSA |
| 647 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSA |
| 648 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSA |
| 649 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSA |
| 650 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSA |
| 651 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSA |

Figure 27 (continued)

| SEQ ID | Sequence |
|---|---|
| 652 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSA |
| 653 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSA |
| 654 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSA |
| 655 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSA |
| 656 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSA |
| 657 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSA |

Figure 27 (continued)

| SEQ ID | Sequence |
|---|---|
| 658 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSA |
| 659 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSA |
| 660 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSA |
| 661 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSA |
| 662 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSA |
| 663 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSA |

Figure 27 (continued)

| SEQ ID | Sequence |
|---|---|
| 664 | EVQLVESGGGVVQPGGSLRLSCAASGFTFSDYWMYWVRQAPGKGLEWVSEINT NGLITKYPDSVKGRFTISRDNAKNTLYLQMNSLRPEDTALYYCARSPSGFNRGQG TLVQVSSGGGGSGGGSEVQLVESGGGLVQPGNSLRLSCAASGFTFSSFGMSWVR QAPGKGLEWVSSISGSGSDTLYADSVKGRFTISRDNAKTTLYLQMNSLRPEDTAV YYCTIGGSLSRSSQGTLVTVSSGGGGSGGGSEVQLVESGGGVVQPGGSLRLSCAA SGFTFSDYWMYWVRQAPGKGLEWVSEINTNGLITKYPDSVKGRFTISRDNAKNT LYLQMNSLRPEDTALYYCARSPSGFNRGQGTLVTVSSA |
| 665 | EVQLVESGGGVVQPGGSLRLSCAASGFTFSDYWMYWVRQAPGKGLEWVSEINT NGLITKYPDSVKGRFTISRDNAKNTLYLQMNSLRPEDTALYYCARSPSGFNRGQG TLVQVSSGGGGSGGGSEVQLVESGGGLVQPGNSLRLSCAASGFTFSSFGMSWVR QAPGKGLEWVSSISGSGSDTLYADSVKGRFTISRDNAKTTLYLQMNSLRPEDTAV YYCTIGGSLSRSSQGTLVTVSSGGGGSGGGSEVQLVESGGGVVQPGGSLRLSCAA SGFTFSDYWMYWVRQAPGKGLEWVSEINTNGLITKYPDSVKGRFTISRDNAKNT LYLQMNSLRPEDTALYYCARSPSGFNRGQGTLVKVSSA |
| 666 | EVQLVESGGGVVQPGGSLRLSCAASGFTFSDYWMYWVRQAPGKGLEWVSEINT NGLITKYPDSVKGRFTISRDNAKNTLYLQMNSLRPEDTALYYCARSPSGFNRGQG TLVQVSSGGGGSGGGSEVQLVESGGGLVQPGNSLRLSCAASGFTFSSFGMSWVR QAPGKGLEWVSSISGSGSDTLYADSVKGRFTISRDNAKTTLYLQMNSLRPEDTAV YYCTIGGSLSRSSQGTLVTVSSGGGGSGGGSEVQLVESGGGVVQPGGSLRLSCAA SGFTFSDYWMYWVRQAPGKGLEWVSEINTNGLITKYPDSVKGRFTISRDNAKNT LYLQMNSLRPEDTALYYCARSPSGFNRGQGTLVQVSSA |
| 667 | EVQLVESGGGVVQPGGSLRLSCAASGFTFSDYWMYWVRQAPGKGLEWVSEINT NGLITKYPDSVKGRFTISRDNAKNTLYLQMNSLRPEDTALYYCARSPSGFNRGQG TLVQVSSGGGGSGGGSEVQLVESGGGVVQPGNSLRLSCAASGFTFSSFGMSWVR QAPGKGLEWVSSISGSGSDTLYADSVKGRFTISRDNAKTTLYLQMNSLRPEDTAL YYCTIGGSLSRSSQGTLVTVSSGGGGSGGGSEVQLVESGGGVVQPGGSLRLSCAA SGFTFSDYWMYWVRQAPGKGLEWVSEINTNGLITKYPDSVKGRFTISRDNAKNT LYLQMNSLRPEDTALYYCARSPSGFNRGQGTLVTVSSA |
| 668 | EVQLVESGGGVVQPGGSLRLSCAASGFTFSDYWMYWVRQAPGKGLEWVSEINT NGLITKYPDSVKGRFTISRDNAKNTLYLQMNSLRPEDTALYYCARSPSGFNRGQG TLVQVSSGGGGSGGGSEVQLVESGGGVVQPGNSLRLSCAASGFTFSSFGMSWVR QAPGKGLEWVSSISGSGSDTLYADSVKGRFTISRDNAKTTLYLQMNSLRPEDTAL YYCTIGGSLSRSSQGTLVTVSSGGGGSGGGSEVQLVESGGGVVQPGGSLRLSCAA SGFTFSDYWMYWVRQAPGKGLEWVSEINTNGLITKYPDSVKGRFTISRDNAKNT LYLQMNSLRPEDTALYYCARSPSGFNRGQGTLVKVSSA |
| 669 | EVQLVESGGGVVQPGGSLRLSCAASGFTFSDYWMYWVRQAPGKGLEWVSEINT NGLITKYPDSVKGRFTISRDNAKNTLYLQMNSLRPEDTALYYCARSPSGFNRGQG TLVQVSSGGGGSGGGSEVQLVESGGGVVQPGNSLRLSCAASGFTFSSFGMSWVR QAPGKGLEWVSSISGSGSDTLYADSVKGRFTISRDNAKTTLYLQMNSLRPEDTAL YYCTIGGSLSRSSQGTLVTVSSGGGGSGGGSEVQLVESGGGVVQPGGSLRLSCAA SGFTFSDYWMYWVRQAPGKGLEWVSEINTNGLITKYPDSVKGRFTISRDNAKNT LYLQMNSLRPEDTALYYCARSPSGFNRGQGTLVQVSSA |

Figure 27 (continued)

| SEQ ID | Sequence |
|---|---|
| 670 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSA |
| 671 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSA |
| 672 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSA |
| 673 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSA |
| 674 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSA |
| 675 | EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSA |

Figure 28A

| SEQ ID | Sequence |
|---|---|
| 676 | DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVTVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSA |
| 677 | DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVTVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSA |
| 678 | DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVTVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVQVSSA |
| 679 | DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVKVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSA |
| 680 | DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVKVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSA |
| 681 | DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVKVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVQVSSA |
| 682 | DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVQVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSA |
| 683 | DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVQVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSA |
| 684 | DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVQVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVQVSSA |

Figure 28B

| SEQ ID | Sequence |
|---|---|
| 685 | DVQLVESGGGVVQPGGSLRLSCAASGFAFDDYAIGWFRQAPGEEREGVSSISSTYGLTYYADSVKGRFTISSDNSKNTVYLQMNSLRPEDTALYYCAATPIGLIGLDAYEYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA |
| 686 | DVQLVESGGGVVQPGGSLRLSCAASGFAFDDYAIGWFRQAPGEEREGVSSISSTYGLTYYADSVKGRFTISSDNSKNTVYLQMNSLRPEDTALYYCAATPIGLIGLDAYEYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSA |
| 687 | DVQLVESGGGVVQPGGSLRLSCAASGFAFDDYAIGWFRQAPGEEREGVSSISSTYGLTYYADSVKGRFTISSDNSKNTVYLQMNSLRPEDTALYYCAATPIGLIGLDAYEYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSA |
| 688 | DVQLVESGGGVVQPGGSLRLSCAASGFAFDDYAIGWFRQAPGEEREGVSSISSTYGLTYYADSVKGRFTISSDNSKNTVYLQMNSLRPEDTALYYCAATPIGLIGLDAYEYDYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA |
| 689 | DVQLVESGGGVVQPGGSLRLSCAASGFAFDDYAIGWFRQAPGEEREGVSSISSTYGLTYYADSVKGRFTISSDNSKNTVYLQMNSLRPEDTALYYCAATPIGLIGLDAYEYDYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSA |
| 690 | DVQLVESGGGVVQPGGSLRLSCAASGFAFDDYAIGWFRQAPGEEREGVSSISSTYGLTYYADSVKGRFTISSDNSKNTVYLQMNSLRPEDTALYYCAATPIGLIGLDAYEYDYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSA |
| 691 | DVQLVESGGGVVQPGGSLRLSCAASGFAFDDYAIGWFRQAPGEEREGVSSISSTYGLTYYADSVKGRFTISSDNSKNTVYLQMNSLRPEDTALYYCAATPIGLIGLDAYEYDYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA |
| 692 | DVQLVESGGGVVQPGGSLRLSCAASGFAFDDYAIGWFRQAPGEEREGVSSISSTYGLTYYADSVKGRFTISSDNSKNTVYLQMNSLRPEDTALYYCAATPIGLIGLDAYEYDYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSA |
| 693 | DVQLVESGGGVVQPGGSLRLSCAASGFAFDDYAIGWFRQAPGEEREGVSSISSTYGLTYYADSVKGRFTISSDNSKNTVYLQMNSLRPEDTALYYCAATPIGLIGLDAYEYDYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSA |

Figure 29

| SEQ ID | Sequence |
|---|---|
| 694 | EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSA |
| 695 | EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVKVSSA |
| 696 | EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVQVSSA |
| 697 | EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSA |
| 698 | EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVKVSSA |
| 699 | EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVQVSSA |

Figure 29 (continued)

| SEQ ID | Sequence |
|---|---|
| 700 | EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSA |
| 701 | EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVKVSSA |
| 702 | EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVQVSSA |
| 703 | EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSA |
| 704 | EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVKVSSA |
| 705 | EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVQVSSA |

Figure 29 (continued)

| SEQ ID | Sequence |
| --- | --- |
| 706 | EVQLVESGGGVVQPGNSLRLSCAASGFTFSSFGMSWVRQAPGKGLEWVSSISGS GSDTLYADSVKGRFTISRDNAKTTLYLQMNSLRPEDTALYYCTIGGSLSRSSQGT LVKVSSGGGGSGGGSEVQLVESGGGLVQPGNSLRLSCAASGFTFSSFGMSWVRQ APGKGLEWVSSISGSGSDTLYADSVKGRFTISRDNAKTTLYLQMNSLRPEDTAVY YCTIGGSLSRSSQGTLVTVSSGGGGSGGGSEVQLVESGGGVVQPGGSLRLSCAAS GFTFSSYPMGWFRQAPGKGREFVSSITGSGGSTYYADSVKGRFTISRDNAKNTLY LQMNSLRPEDTALYYCAAYIRPDTYLSRDYRKYDYWGQGTLVTVSSA |
| 707 | EVQLVESGGGVVQPGNSLRLSCAASGFTFSSFGMSWVRQAPGKGLEWVSSISGS GSDTLYADSVKGRFTISRDNAKTTLYLQMNSLRPEDTALYYCTIGGSLSRSSQGT LVKVSSGGGGSGGGSEVQLVESGGGLVQPGNSLRLSCAASGFTFSSFGMSWVRQ APGKGLEWVSSISGSGSDTLYADSVKGRFTISRDNAKTTLYLQMNSLRPEDTAVY YCTIGGSLSRSSQGTLVTVSSGGGGSGGGSEVQLVESGGGVVQPGGSLRLSCAAS GFTFSSYPMGWFRQAPGKGREFVSSITGSGGSTYYADSVKGRFTISRDNAKNTLY LQMNSLRPEDTALYYCAAYIRPDTYLSRDYRKYDYWGQGTLVKVSSA |
| 708 | EVQLVESGGGVVQPGNSLRLSCAASGFTFSSFGMSWVRQAPGKGLEWVSSISGS GSDTLYADSVKGRFTISRDNAKTTLYLQMNSLRPEDTALYYCTIGGSLSRSSQGT LVKVSSGGGGSGGGSEVQLVESGGGLVQPGNSLRLSCAASGFTFSSFGMSWVRQ APGKGLEWVSSISGSGSDTLYADSVKGRFTISRDNAKTTLYLQMNSLRPEDTAVY YCTIGGSLSRSSQGTLVTVSSGGGGSGGGSEVQLVESGGGVVQPGGSLRLSCAAS GFTFSSYPMGWFRQAPGKGREFVSSITGSGGSTYYADSVKGRFTISRDNAKNTLY LQMNSLRPEDTALYYCAAYIRPDTYLSRDYRKYDYWGQGTLVQVSSA |
| 709 | EVQLVESGGGVVQPGNSLRLSCAASGFTFSSFGMSWVRQAPGKGLEWVSSISGS GSDTLYADSVKGRFTISRDNAKTTLYLQMNSLRPEDTALYYCTIGGSLSRSSQGT LVKVSSGGGGSGGGSEVQLVESGGGVVQPGNSLRLSCAASGFTFSSFGMSWVRQ APGKGLEWVSSISGSGSDTLYADSVKGRFTISRDNAKTTLYLQMNSLRPEDTALY YCTIGGSLSRSSQGTLVTVSSGGGGSGGGSEVQLVESGGGVVQPGGSLRLSCAAS GFTFSSYPMGWFRQAPGKGREFVSSITGSGGSTYYADSVKGRFTISRDNAKNTLY LQMNSLRPEDTALYYCAAYIRPDTYLSRDYRKYDYWGQGTLVTVSSA |
| 710 | EVQLVESGGGVVQPGNSLRLSCAASGFTFSSFGMSWVRQAPGKGLEWVSSISGS GSDTLYADSVKGRFTISRDNAKTTLYLQMNSLRPEDTALYYCTIGGSLSRSSQGT LVKVSSGGGGSGGGSEVQLVESGGGVVQPGNSLRLSCAASGFTFSSFGMSWVRQ APGKGLEWVSSISGSGSDTLYADSVKGRFTISRDNAKTTLYLQMNSLRPEDTALY YCTIGGSLSRSSQGTLVTVSSGGGGSGGGSEVQLVESGGGVVQPGGSLRLSCAAS GFTFSSYPMGWFRQAPGKGREFVSSITGSGGSTYYADSVKGRFTISRDNAKNTLY LQMNSLRPEDTALYYCAAYIRPDTYLSRDYRKYDYWGQGTLVKVSSA |
| 711 | EVQLVESGGGVVQPGNSLRLSCAASGFTFSSFGMSWVRQAPGKGLEWVSSISGS GSDTLYADSVKGRFTISRDNAKTTLYLQMNSLRPEDTALYYCTIGGSLSRSSQGT LVKVSSGGGGSGGGSEVQLVESGGGVVQPGNSLRLSCAASGFTFSSFGMSWVRQ APGKGLEWVSSISGSGSDTLYADSVKGRFTISRDNAKTTLYLQMNSLRPEDTALY YCTIGGSLSRSSQGTLVTVSSGGGGSGGGSEVQLVESGGGVVQPGGSLRLSCAAS GFTFSSYPMGWFRQAPGKGREFVSSITGSGGSTYYADSVKGRFTISRDNAKNTLY LQMNSLRPEDTALYYCAAYIRPDTYLSRDYRKYDYWGQGTLVQVSSA |

Figure 29 (continued)

| SEQ ID | Sequence |
|---|---|
| 712 | EVQLVESGGGVVQPGNSLRLSCAASGFTFSSFGMSWVRQAPGKGLEWVSSISGS GSDTLYADSVKGRFTISRDNAKTTLYLQMNSLRPEDTALYYCTIGGSLSRSSQGT LVKVSSGGGGSGGGSEVQLVESGGGVVQPGNSLRLSCAASGFTFSSFGMSWVRQ APGKGLEWVSSISGSGSDTLYADSVKGRFTISRDNAKTTLYLQMNSLRPEDTALY YCTIGGSLSRSSQGTLVKVSSGGGGSGGGSEVQLVESGGGVVQPGGSLRLSCAAS GFTFSSYPMGWFRQAPGKGREFVSSITGSGGSTYYADSVKGRFTISRDNAKNTLY LQMNSLRPEDTALYYCAAYIRPDTYLSRDYRKYDYWGQGTLVTVSSA |
| 713 | EVQLVESGGGVVQPGNSLRLSCAASGFTFSSFGMSWVRQAPGKGLEWVSSISGS GSDTLYADSVKGRFTISRDNAKTTLYLQMNSLRPEDTALYYCTIGGSLSRSSQGT LVKVSSGGGGSGGGSEVQLVESGGGVVQPGNSLRLSCAASGFTFSSFGMSWVRQ APGKGLEWVSSISGSGSDTLYADSVKGRFTISRDNAKTTLYLQMNSLRPEDTALY YCTIGGSLSRSSQGTLVKVSSGGGGSGGGSEVQLVESGGGVVQPGGSLRLSCAAS GFTFSSYPMGWFRQAPGKGREFVSSITGSGGSTYYADSVKGRFTISRDNAKNTLY LQMNSLRPEDTALYYCAAYIRPDTYLSRDYRKYDYWGQGTLVKVSSA |
| 714 | EVQLVESGGGVVQPGNSLRLSCAASGFTFSSFGMSWVRQAPGKGLEWVSSISGS GSDTLYADSVKGRFTISRDNAKTTLYLQMNSLRPEDTALYYCTIGGSLSRSSQGT LVKVSSGGGGSGGGSEVQLVESGGGVVQPGNSLRLSCAASGFTFSSFGMSWVRQ APGKGLEWVSSISGSGSDTLYADSVKGRFTISRDNAKTTLYLQMNSLRPEDTALY YCTIGGSLSRSSQGTLVKVSSGGGGSGGGSEVQLVESGGGVVQPGGSLRLSCAAS GFTFSSYPMGWFRQAPGKGREFVSSITGSGGSTYYADSVKGRFTISRDNAKNTLY LQMNSLRPEDTALYYCAAYIRPDTYLSRDYRKYDYWGQGTLVQVSSA |
| 715 | EVQLVESGGGVVQPGNSLRLSCAASGFTFSSFGMSWVRQAPGKGLEWVSSISGS GSDTLYADSVKGRFTISRDNAKTTLYLQMNSLRPEDTALYYCTIGGSLSRSSQGT LVKVSSGGGGSGGGSEVQLVESGGGVVQPGNSLRLSCAASGFTFSSFGMSWVRQ APGKGLEWVSSISGSGSDTLYADSVKGRFTISRDNAKTTLYLQMNSLRPEDTALY YCTIGGSLSRSSQGTLVQVSSGGGGSGGGSEVQLVESGGGVVQPGGSLRLSCAAS GFTFSSYPMGWFRQAPGKGREFVSSITGSGGSTYYADSVKGRFTISRDNAKNTLY LQMNSLRPEDTALYYCAAYIRPDTYLSRDYRKYDYWGQGTLVTVSSA |
| 716 | EVQLVESGGGVVQPGNSLRLSCAASGFTFSSFGMSWVRQAPGKGLEWVSSISGS GSDTLYADSVKGRFTISRDNAKTTLYLQMNSLRPEDTALYYCTIGGSLSRSSQGT LVKVSSGGGGSGGGSEVQLVESGGGVVQPGNSLRLSCAASGFTFSSFGMSWVRQ APGKGLEWVSSISGSGSDTLYADSVKGRFTISRDNAKTTLYLQMNSLRPEDTALY YCTIGGSLSRSSQGTLVQVSSGGGGSGGGSEVQLVESGGGVVQPGGSLRLSCAAS GFTFSSYPMGWFRQAPGKGREFVSSITGSGGSTYYADSVKGRFTISRDNAKNTLY LQMNSLRPEDTALYYCAAYIRPDTYLSRDYRKYDYWGQGTLVKVSSA |
| 717 | EVQLVESGGGVVQPGNSLRLSCAASGFTFSSFGMSWVRQAPGKGLEWVSSISGS GSDTLYADSVKGRFTISRDNAKTTLYLQMNSLRPEDTALYYCTIGGSLSRSSQGT LVKVSSGGGGSGGGSEVQLVESGGGVVQPGNSLRLSCAASGFTFSSFGMSWVRQ APGKGLEWVSSISGSGSDTLYADSVKGRFTISRDNAKTTLYLQMNSLRPEDTALY YCTIGGSLSRSSQGTLVQVSSGGGGSGGGSEVQLVESGGGVVQPGGSLRLSCAAS GFTFSSYPMGWFRQAPGKGREFVSSITGSGGSTYYADSVKGRFTISRDNAKNTLY LQMNSLRPEDTALYYCAAYIRPDTYLSRDYRKYDYWGQGTLVQVSSA |

Figure 29 (continued)

| SEQ ID | Sequence |
|---|---|
| 718 | EVQLVESGGGVVQPGNSLRLSCAASGFTFSSFGMSWVRQAPGKGLEWVSSISGS GSDTLYADSVKGRFTISRDNAKTTLYLQMNSLRPEDTALYYCTIGGSLSRSSQGT LVQVSSGGGGSGGGSEVQLVESGGGLVQPGNSLRLSCAASGFTFSSFGMSWVRQ APGKGLEWVSSISGSGSDTLYADSVKGRFTISRDNAKTTLYLQMNSLRPEDTAVY YCTIGGSLSRSSQGTLVTVSSGGGGSGGGSEVQLVESGGGVVQPGGSLRLSCAAS GFTFSSYPMGWFRQAPGKGREFVSSITGSGGSTYYADSVKGRFTISRDNAKNTLY LQMNSLRPEDTALYYCAAYIRPDTYLSRDYRKYDYWGQGTLVTVSSA |
| 719 | EVQLVESGGGVVQPGNSLRLSCAASGFTFSSFGMSWVRQAPGKGLEWVSSISGS GSDTLYADSVKGRFTISRDNAKTTLYLQMNSLRPEDTALYYCTIGGSLSRSSQGT LVQVSSGGGGSGGGSEVQLVESGGGLVQPGNSLRLSCAASGFTFSSFGMSWVRQ APGKGLEWVSSISGSGSDTLYADSVKGRFTISRDNAKTTLYLQMNSLRPEDTAVY YCTIGGSLSRSSQGTLVTVSSGGGGSGGGSEVQLVESGGGVVQPGGSLRLSCAAS GFTFSSYPMGWFRQAPGKGREFVSSITGSGGSTYYADSVKGRFTISRDNAKNTLY LQMNSLRPEDTALYYCAAYIRPDTYLSRDYRKYDYWGQGTLVKVSSA |
| 720 | EVQLVESGGGVVQPGNSLRLSCAASGFTFSSFGMSWVRQAPGKGLEWVSSISGS GSDTLYADSVKGRFTISRDNAKTTLYLQMNSLRPEDTALYYCTIGGSLSRSSQGT LVQVSSGGGGSGGGSEVQLVESGGGLVQPGNSLRLSCAASGFTFSSFGMSWVRQ APGKGLEWVSSISGSGSDTLYADSVKGRFTISRDNAKTTLYLQMNSLRPEDTAVY YCTIGGSLSRSSQGTLVTVSSGGGGSGGGSEVQLVESGGGVVQPGGSLRLSCAAS GFTFSSYPMGWFRQAPGKGREFVSSITGSGGSTYYADSVKGRFTISRDNAKNTLY LQMNSLRPEDTALYYCAAYIRPDTYLSRDYRKYDYWGQGTLVQVSSA |
| 721 | EVQLVESGGGVVQPGNSLRLSCAASGFTFSSFGMSWVRQAPGKGLEWVSSISGS GSDTLYADSVKGRFTISRDNAKTTLYLQMNSLRPEDTALYYCTIGGSLSRSSQGT LVQVSSGGGGSGGGSEVQLVESGGGVVQPGNSLRLSCAASGFTFSSFGMSWVRQ APGKGLEWVSSISGSGSDTLYADSVKGRFTISRDNAKTTLYLQMNSLRPEDTALY YCTIGGSLSRSSQGTLVTVSSGGGGSGGGSEVQLVESGGGVVQPGGSLRLSCAAS GFTFSSYPMGWFRQAPGKGREFVSSITGSGGSTYYADSVKGRFTISRDNAKNTLY LQMNSLRPEDTALYYCAAYIRPDTYLSRDYRKYDYWGQGTLVTVSSA |
| 722 | EVQLVESGGGVVQPGNSLRLSCAASGFTFSSFGMSWVRQAPGKGLEWVSSISGS GSDTLYADSVKGRFTISRDNAKTTLYLQMNSLRPEDTALYYCTIGGSLSRSSQGT LVQVSSGGGGSGGGSEVQLVESGGGVVQPGNSLRLSCAASGFTFSSFGMSWVRQ APGKGLEWVSSISGSGSDTLYADSVKGRFTISRDNAKTTLYLQMNSLRPEDTALY YCTIGGSLSRSSQGTLVTVSSGGGGSGGGSEVQLVESGGGVVQPGGSLRLSCAAS GFTFSSYPMGWFRQAPGKGREFVSSITGSGGSTYYADSVKGRFTISRDNAKNTLY LQMNSLRPEDTALYYCAAYIRPDTYLSRDYRKYDYWGQGTLVKVSSA |
| 723 | EVQLVESGGGVVQPGNSLRLSCAASGFTFSSFGMSWVRQAPGKGLEWVSSISGS GSDTLYADSVKGRFTISRDNAKTTLYLQMNSLRPEDTALYYCTIGGSLSRSSQGT LVQVSSGGGGSGGGSEVQLVESGGGVVQPGNSLRLSCAASGFTFSSFGMSWVRQ APGKGLEWVSSISGSGSDTLYADSVKGRFTISRDNAKTTLYLQMNSLRPEDTALY YCTIGGSLSRSSQGTLVTVSSGGGGSGGGSEVQLVESGGGVVQPGGSLRLSCAAS GFTFSSYPMGWFRQAPGKGREFVSSITGSGGSTYYADSVKGRFTISRDNAKNTLY LQMNSLRPEDTALYYCAAYIRPDTYLSRDYRKYDYWGQGTLVQVSSA |

Figure 29 (continued)

| SEQ ID | Sequence |
|---|---|
| 724 | EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSA |
| 725 | EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVKVSSA |
| 726 | EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVQVSSA |
| 727 | EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSA |
| 728 | EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVKVSSA |
| 729 | EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVQVSSA |

Figure 30

| SEQ ID | Sequence |
|---|---|
| 730 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |
| 731 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA |
| 732 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |
| 733 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |
| 734 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA |

Figure 30 (continued)

| SEQ ID | Sequence |
|---|---|
| 735 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |
| 736 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |
| 737 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA |
| 738 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |
| 739 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |

Figure 30 (continued)

| SEQ ID | Sequence |
|---|---|
| 740 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA |
| 741 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |
| 742 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |
| 743 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA |
| 744 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |

Figure 30 (continued)

| SEQ ID | Sequence |
|---|---|
| 745 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |
| 746 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA |
| 747 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |
| 748 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |
| 749 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA |

Figure 30 (continued)

| SEQ ID | Sequence |
|---|---|
| 750 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |
| 751 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |
| 752 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA |
| 753 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |
| 754 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVQVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |

Figure 30 (continued)

| SEQ ID | Sequence |
|---|---|
| 755 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVQVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA |
| 756 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVQVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |
| 757 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |
| 758 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA |
| 759 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |

Figure 30 (continued)

| SEQ ID | Sequence |
|---|---|
| 760 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |
| 761 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA |
| 762 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |
| 763 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |
| 764 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA |

Figure 30 (continued)

| SEQ ID | Sequence |
|---|---|
| 765 | EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA |
| 766 | EVQLLESGGGLVQPGGSLRLSCVHSGPTFRTDTMGWFRQAPGKGREFVAAVTWNSGRINYADSVKGRFTISRDNSKNTAYLQMNSLRPEDTAVYYCAAHRFVVGGNRVEDWRYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGLVQPGGSLRLSCAASGRTFNNYNMGWFRQAPGKGREFVAAVSRSGVSTYYADSVKGRFTISRDNSKNTVYLQMNSLRPEDTAVYYCAAAYRGTAINVRRSYSSWGQGTLVTVSSA |

IMMUNOGLOBULIN VARIABLE DOMAINS

RELATED APPLICATIONS

This application is a divisional application of U.S. application Ser. No. 16/695,420, filed Nov. 26, 2019, which is a divisional application of U.S. application Ser. No. 15/311,564, filed Nov. 16, 2016, which is a national stage filing under 35 U.S.C. § 371 of International Application No. PCT/EP2015/060643, filed May 13, 2015, which was published under PCT Article 21(2) in English, and claims the benefit under 35 U.S.C. § 119(e) of U.S. provisional application Ser. No. 61/994,552, filed May 16, 2014, U.S. provisional application Ser. No. 62/014,015, filed Jun. 18, 2014, U.S. provisional application Ser. No. 62/040,167, filed Aug. 21, 2014, U.S. provisional application Ser. No. 62/047,560, filed Sep. 8, 2014, and U.S. provisional application Ser. No. 62/133,600, filed Mar. 16, 2015, the entire contents of each of which is incorporated by reference herein in its entirety.

REFERENCE TO A SEQUENCE LISTING SUBMITTED AS A TEXT FILE VIA EFS-WEB

The instant application contains a Sequence Listing which has been submitted in ASCII format via EFS-Web and is hereby incorporated by reference in its entirety. Said ASCII copy, created on Mar. 9, 2022, is named A084870168US12-SEQ-CRP, and is 1,309,413 bytes in size.

BRIEF DESCRIPTION OF THE DRAWINGS

The invention will now be further described by means of the following non-limiting preferred aspects, examples and figures, in which:

FIG. 1 is a table listing some of the amino acid positions that will be specifically referred to herein and their numbering according to some alternative numbering systems (such as Aho and IMGT);

FIG. 2 lists the sequences referred to herein;

FIGS. 9A and 9B show preferred but non-limiting examples of monovalent Nanobodies of the invention (FIG. 9A) and trivalent bispecific half-life extended compounds of the invention (FIG. 9B) against the ion channel Kv1.3; and FIG. 9C lists some preferred CDRs (classification according to Kabat and Abm, respectively) for ISVDs against Kv1.3.

FIGS. 12A and 12B list the CDR's and amino sequences of some preferred, but non-limiting examples of Nanobodies of the invention against IL-23 that are based on the indicated reference sequences. See also Example 8;

FIG. 13 lists the CDR's and amino sequences of some preferred, but non-limiting examples of Nanobodies of the invention against OX40-L that are based on the indicated reference sequence. See also Example 9;

FIG. 14 lists the CDR's and amino sequences of some preferred, but non-limiting examples of Nanobodies of the invention against IgE that are based on the indicated reference sequence. See also Example 10;

FIGS. 15A and 15B list the CDR's and amino sequences of some preferred, but non-limiting examples of Nanobodies of the invention against CXCR-4 that are based on the indicated reference sequences. See also Example 11;

FIGS. 16A and 16B list the CDR's and amino sequences of some preferred, but non-limiting examples of Nanobodies of the invention against HER-3 that are based on the indicated reference sequences. See also Example 12;

FIGS. 17A and 17B list the CDR's and amino sequences of some preferred, but non-limiting examples of Nanobodies of the invention against TNF that are based on the indicated reference sequences. See also Examples 13 and 14;

FIGS. 18A and 18B list the CDR's and amino sequences of some preferred, but non-limiting examples of Nanobodies of the invention against c-Met that are based on the indicated reference sequences. See also Example 15;

FIG. 19 lists the CDR's and amino sequences of some preferred, but non-limiting examples of Nanobodies of the invention against RANK-L that are based on the indicated reference sequence. See also Example 16;

FIGS. 20A to 20C list the CDR's and amino sequences of some preferred, but non-limiting examples of Nanobodies of the invention against CXCR-7 that are based on the indicated reference sequences. See also Example 17;

FIGS. 21A and 21B list the CDR's and amino sequences of some preferred, but non-limiting examples of Nanobodies of the invention against A-beta that are based on the indicated reference sequences. See also Example 18;

FIG. 22 gives the amino acid sequences of some preferred but non-limiting examples of compounds of the invention against IL-23;

FIG. 23 gives the amino acid sequences of some preferred but non-limiting examples of compounds of the invention against OX40-L;

FIG. 24 gives the amino acid sequences of some preferred but non-limiting examples of compounds of the invention against IgE;

FIG. 25 gives the amino acid sequences of some preferred but non-limiting examples of compounds of the invention against CXCR-4;

FIG. 26 gives the amino acid sequences of some preferred but non-limiting examples of compounds of the invention against HER-3;

FIG. 27 gives the amino acid sequences of some preferred but non-limiting examples of compounds of the invention against TNF;

FIGS. 28A and 28B give the amino acid sequences of some preferred but non-limiting examples of compounds of the invention against c-Met;

FIG. 29 gives the amino acid sequences of some preferred but non-limiting examples of compounds of the invention against RANK-L;

FIG. 30 gives the amino acid sequences of some preferred but non-limiting examples of compounds of the invention against A-beta;

DESCRIPTION

Figure 3:
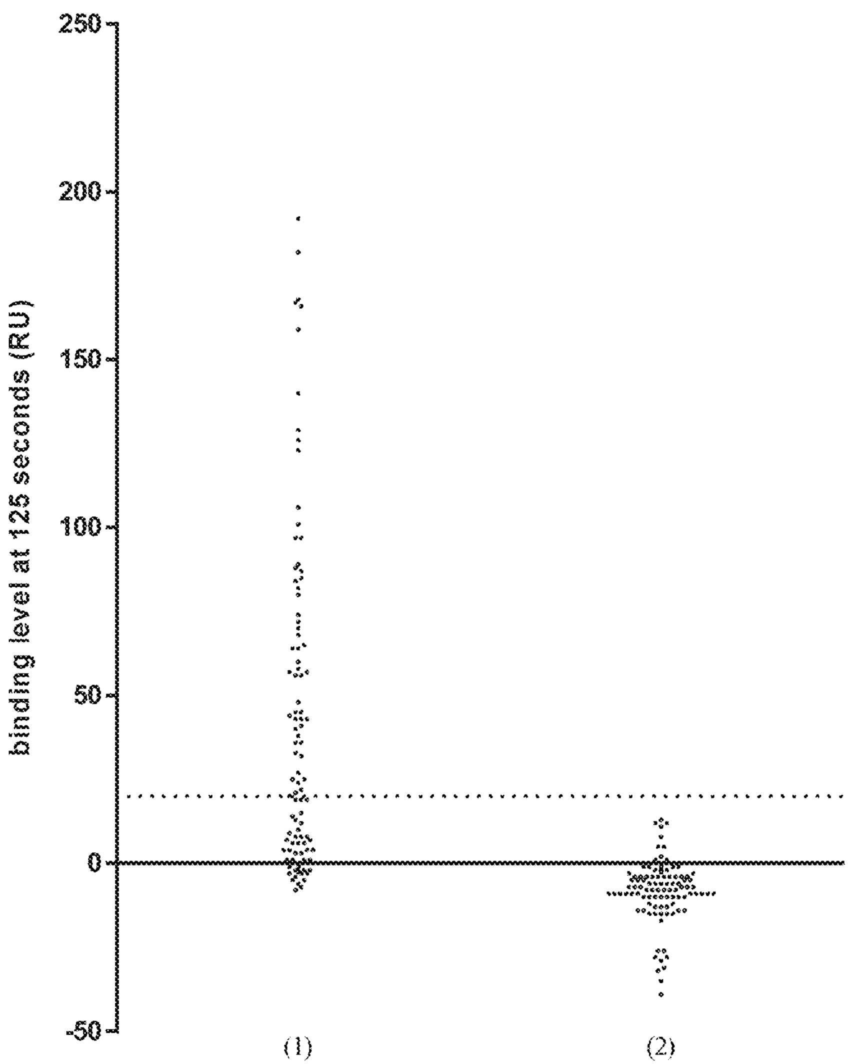
FIG. 3 is a plot showing data points obtained in Example 4 when 96 serum samples were tested for binding a representative Nanobody with an S112K mutation (Reference A+S 112K+C-terminal alanine, indicated as (2) in FIG. 3), compared to a reference Nanobody without an S112K mutation (Reference A, SEQ ID NO: 44, indicated as (1) in FIG. 3)

The present invention relates to improved heavy-chain immunoglobulin variable domains.

The invention in particular refers to improved heavy-chain immunoglobulin variable domains that either have an exposed C-terminal region or end (as further described herein; see also WO 12/175741) or that are used in (or intended for use in) applications where they have an exposed C-terminal region or end (again, as further described herein). Some preferred but non-limiting examples of the former are immunoglobulin single variable domains (also referred to herein as "ISV's" or "ISVD's") such as Nanobodies (including VHH's, humanized VHH's and camelized VH's such as camelized human VH's), (single domain) antibodies that are VH domains or derived from VH domains, and dAb's that are VH domains or derived from VH domains. Some preferred but non-limiting examples of the latter are VH domains that are used in (or intended for use in) single chain FV's (ScFv's) or diabodies.

The invention also relates to proteins, polypeptides and other constructs, molecules or chemical entities that comprise or essentially consist of (one or more of) the improved heavy-chain immunoglobulin variable domains of the invention as described herein; to methods for expressing/producing the improved heavy-chain immunoglobulin variable domains of the invention and/or for expressing/producing proteins, polypeptides and other constructs, molecules or chemical entities comprising the same; to compositions and products (such as pharmaceutical compositions and products) that comprise the improved heavy-chain immunoglobulin variable domains of the invention and/or proteins, polypeptides and other constructs, molecules or chemical entities comprising the same; to nucleotide sequence and nucleic acids that encode the improved heavy-chain immunoglobulin variable domains of the invention and/or that encode proteins or polypeptides comprising the same; and to uses (and in particular therapeutic, prophylactic and diagnostic uses) of the improved heavy-chain immunoglobulin variable domains of the invention and of proteins, polypeptides and other constructs, molecules or chemical entities comprising the same.

Further aspects, embodiments, advantages, applications and uses of the invention will become clear from the further description herein.

In the present application, the amino acid residues/positions in an immunoglobulin heavy-chain variable domain will be indicated with the numbering according to Kabat. For the sake of convenience, FIG. 1 gives a table listing some of the amino acid positions that will be specifically referred to herein and their numbering according to some alternative numbering systems (such as Aho and IMGT. Note: for the present description and claims, Kabat numbering is decisive; other numbering systems are given for reference only).

Also, in the invention, an immunoglobulin variable domain is said to have "an exposed C-terminal end or region" when it is not associated with or linked to a constant domain (such as a $C_H1$ domain). Reference is made to the relevant prior art cited herein.

In particular, as described in WO 12/175741, the C-terminal region (as this term is also used herein) is part of a putative epitope on the ISV that also includes, among other residues, the amino acid residue at position 14 (and the amino acid residues next/close to the same in the amino acid sequence, such as positions 11, 13 and 15) and may also comprise the amino acid residue at position 83 (and the amino acid residues next/close to the same in the amino acid sequence, such as positions 82, 82a, 82b and 84) and/or the amino acid residue at position 108 (and the amino acid residues next/close to the same in the amino acid sequence, such as positions 107. As in WO 12/17574, this putative epitope is also collectively referred to herein as the "C-terminal region", it being understood that this C-terminal region at least comprises the C terminal sequence VTVSS (i.e. each of positions 109, 110, 111, 112 and 113) and the amino acid residue at position 14, and may also comprise the amino acid residues at positions 83 and 108, and possibly also the amino acid residues at positions 13, 15, 82b, 83, 84 and 107.

As a result of research into single chain Fv's or "ScFv's" (which are constructs that contain immunoglobulin variable domains that, similar to ISVD's, are not associated with constant domains), it has been described in the art that the C-terminus of an immunoglobulin variable domain contains a hydrophobic patch that in a conventional full-sized antibody is buried in the interface between the variable domain and the constant domain but that becomes solvent-exposed when the variable domain is not associated with a constant domain (see for example Nieba et al., Protein Engineering, 10, 435-444 (1997) and Harmsen et al., Molecular Immunology (2000), 579-590).

It is also well known that epitopes that are usually buried within the structure of a protein (also referred to as "neo-epitopes" or "cryptic epitopes") may trigger the immune system once they become solvent-exposed, for example due to degradation, misfolding or aggregation of the protein involved. For example, in the case of buried hydrophobic portions of biomolecules (so-called "hyppos"), it has been suggested that these form part of a general damage-associated molecular pattern that leads to innate immune responses once the hyppos become solvent-exposed (see for example Seong and Matzinger, Nature Reviews 2004, 469), and various examples of previously-buried hydrophobic patches triggering immune responses have been described in the art (see for example David et al., JBC, 2001, 6370-6377; Matsuura et al., International Immunology, 2000, 1183-1192; Rasheed et al., Life Sciences 79 (2000), 2320-2328). More generally, it is also known in the art that hydrophobic amino acids are prone to be part of B-cell epitopes (see for example WO 11/07586, page 10; and Kolaskar, FEBS 276, 172-174 (1990)). Similarly, it has been described that the hydrophobic patch at the C-terminus of a heavy-chain variable domain (as described by Nieba et al. and Harmsen et al., supra) may form B-cell epitopes which can give rise to and/or interact with (emerging and/or pre-existing) anti-drug antibodies (WO 11/07586). For this reason, it has been proposed to make mutations to some of the amino acid residues that form part of the C-terminus of the variable domains to reduce hydrophobicity and/or to remove B-cell epitopes. For example, Nieba et al. suggest to mutate positions 11, 14, 41, 84, 87 and/or 89 of a VH region (numbering according to Kabat), whereas in WO 11/07586 it is suggested to mutate positions 99, 101 and/or 148 (AHo numbering) of a VL domain or positions 12, 97, 98, 99, 103 and/or 144 of a VH domain (again AHo numbering—these positions correspond to positions 11, 83, 84, 85, 89 and 103 according to Kabat). Similarly, Harmsen et al. suggest to mutate positions 12 and 101 (IMGT numbering; these are positions 11 and 89 according to Kabat) to compensate for the absence of a $C_H1$ domain; and they also identify a specific subfamily of VHH's (called "VHH4's") that contain amino acids that are suitable candidates for substitutions at these positions.

It has also been described in the art (see for example WO 12/175741 and the references cited in the next paragraphs) that biological samples obtained from human subjects may contain (pre-existing) proteins or factors that are capable of binding to the exposed C-terminal region or end of an immunoglobulin variable domain (for example, the C-terminal region or end of an ISVD or of a VH or VL domain in an ScFv or diabody).

For example, WO 2013/024059 states that "in sera from some healthy naive human subjects, pre-existing anti-VH autoantibodies are present that can bind both VH domain antibodies and VHH molecules, as well as anti-VL (eg V kappa (VK)) autoantibodies that can bind VL molecules.", and that "the pre-existing ADAs that bind VH dAbs are similar to anti-hinge antibodies in that they bind IgG fragments but not those same sequences found in situ on intact IgG."

Holland et al., J. Clin. Immunol. 2013, 33(7):1192-203 describe that the blood of around half of normal healthy humans contain varying levels of a new class of anti-IgG autoantibodies that can bind to the framework sequences of fully human $V_H$ domain antibodies (which Holland et al. also refer to as "HAVH auto-antibodies"). Holland et al. further mention that these auto-antibodies appear to be predominantly of the IgG isotype, display a relatively high affinity (about $10^{-10}$M) affinity for $V_H$ sequences, and that a free C-terminus appears to be important for the binding of these HAVH autoantibodies to $V_H$ domains.

The issues relating to pre-existing biotherapeutic-reactive antibodies against biotherapeutic molecules and their regulatory impact are also generally discussed by Xue et al., AAPS J. 2013; 15(3):852-5.

The aforementioned prior art has also focused on ways in which the sequence of an immunoglobulin variable domain may be modified so as to prevent or reduce binding of such pre-existing antibodies/factor(s) to the variable domains. In this respect, WO 2011/07586 suggests to make one or more mutations in the amino acid sequence of the variable domain at some specific positions of the domain (which positions are surface-exposed). WO 12/175741 describes that the binding of such pre-existing antibodies/factors may be reduced by adding a few amino acid residues (and as little as one alanine residue) to the C-terminal end of the VH-domain and/or by making one or more specific substitutions or deletions within the C-terminal region of the variable domain, which is described in WO 12/175741 as at least comprising the C-terminal amino acid sequence VTVSS and the amino acid residue at position 14 (for which position WO 12/175741 teaches that the presence of an alanine residue provides for reduced binding of pre-existing antibodies as compared to the presence of the "human" amino acid residue proline), and possibly also the amino acid residues at positions 108 and 83 and amino acid residues close to said positions (WO 2013/024059 provides essentially the same teaching as WO 12/175741).

For example, in research performed by applicant/assignee leading up to the filing of WO 12/175741, it has been found that adding a single alanine residue to the C-terminal region or end of an exposed VH domain will usually prevent/remove (essentially all of) the binding of pre-existing antibodies/factors that are present in samples obtained from most human subjects (see for example page 62, lines 20-25 and page 57, line 30 to page 58, lines 3 of WO 12/175741);

and these findings have been confirmed by additional results that were obtained by applicant/assignee after the filing of WO 12/175741 when the C-terminal alanine substitution of WO 12/175741 was applied to other Nanobodies (data not shown).

Also, in WO 12/175741 as well as in WO 12/175400 by applicant/assignee, the C-terminal extensions described in WO 12/175741 are applied to certain serum-albumin-binding Nanobodies (see for example WO 12/175741: SEQ ID NO's: 37, 51-53 and 55-64 and the constructs shown in SEQ ID NO's: 41, 43 and 44; and WO 12/175400: SEQ ID NO's: 6 to 11).

FIG. 9 of WO 12/175741 also describes two albumin-binding sequences that are used as reference sequences in the Experimental Part below. These are SEQ ID NO:37 from FIG. 9 of WO 12/175741 (also referred to herein as "Reference B"; its sequence is given herein as SEQ ID NO: 45) and "SEQ ID NO:37 without the added C-terminal amino acid residues" from FIG. 9 of WO 12/175741 (also referred to herein as "Reference A"; its sequence is given in SEQ ID NO:44). Reference A and Reference B are both derived from the sequence of the humanized anti-albumin Nanobody "Alb-8" that is given as SEQ ID NO:62 in WO 06/122787 (and that is also referred to herein as "Alb-11"); but, compared to the sequence of Alb-11, Reference A comprises an N-terminal His tag; and Reference B comprises an N-terminal His tag and a C-terminal alanine residue. Reference A, Reference B and Alb-8/Alb-11 all contain the CDRs given in SEQ ID NO's: 41 to 43, respectively.

Other examples of Nanobodies and other immunoglobulin single variable domains that have C-terminal extensions and/or mutations in the C-terminal region can for example be found in the following prior art: WO 06/129843 (see for example SEQ ID NO's: 4, 6, 8 and 10); WO 03/035695 (see for example some of the sequences listed on pages 61-64); Vu et al., Molecular Immunology, 1121-1131, 1997 (see for example some of the sequences listed in FIG. 2); WO 11/003622 (see for example the sequences given as SEQ ID NO's: 10 to 27); WO09/058383 (see for example the sequence TAR2h-10-27 mentioned on page 51); WO 10/042815 (see for example the sequences of SEQ ID NO's: 15, 17, 27 and 30); and WO 04/044204 (see for example the sequences of SEQ ID NO's: 31, 35, 37, 47 and 49).

Some of the references cited herein also give examples of ISVD sequences in which the last C-terminal amino acid of the ISVD is an amino acid other than serine (S), for example because the serine at position 113 has been replaced by another amino acid and/or because the serine at position 113 has been deleted and a C-terminal amino acid has been added (in practice, the end-result in terms of the C-terminal amino acid sequence will be the same).

Some of the references cited herein also give examples of Nanobodies and other immunoglobulin single variable domains in which position 112 is an amino acid other than serine. For example, WO 12/175741 describes Nanobodies in which position 112 is glycine (G); Vu at al. (supra) describes Nanobodies in which position 112 is alanine (A) or isoleucine (I); WO 13/024059 exemplifies a S112A substitution; and WO 08/020079 cited below exemplifies an S112F substitution and also generally states that the Nanobodies described therein can contain a limited number of amino acid residues added at the carboxy-terminal end of the amino acid sequence of the Nanobody.

In the research leading up to the present invention, after having established that adding C-terminal extension (which may be as simple as a single C-terminal alanine residue, see again WO 12/175741, Example 3) to the C-terminal region or end of a nanobody essentially prevents/removes binding of pre-existing antibodies/factors in most samples of human subjects/patients, it was investigated whether samples obtained from human subjects (healthy volunteers and/or subjects suffering from a disease or disorder) possibly contain (other) pre-existing antibodies or factors that can bind to the exposed C-terminal region of a nanobody (or other VH domain) even when a C-terminal extension is present. In doing so, the present inventors have found that, although essentially no such pre-existing antibodies binding to a C-terminally extended VH domain can be found in the blood or serum of healthy volunteers or in blood or serum obtained from human patients suffering from one of a number of different diseases (including some inflammatory diseases or auto-immune disorders—data not shown), some blood or serum samples that have been obtained from certain (but not all) human subjects suffering from certain severe (auto-)immune disorders (such as systemic lupus erythematosus; also abbreviated herein as "SLE") appear to contain some pre-existing antibodies/factors that can bind to nanobodies even when said nanobodies comprise a C-terminal extension.

Thus, generally, the purpose of the present invention is to provide improved heavy-chain immunoglobulin variable domains (and in particular improved heavy-chain ISVD's and more in particular improved nanobodies) that, when they have an exposed C-terminal region or end, are less prone to be bound by pre-existing antibodies/factors, such as those found in blood or serum samples obtained from human subjects.

In particular, the purpose of the present invention is to provide improved heavy-chain immunoglobulin variable domains that, when they have an exposed C-terminal region or end, are less prone to binding by pre-existing antibodies/factors (again, such as those found in blood or serum samples obtained from human subjects) that can still bind to the exposed C-terminal region or end of the heavy-chain variable domain when said domain comprises a C-terminal extension (for example, as described in WO 12/175741, WO 13/024059 and the further prior art cited herein).

As mentioned herein, such pre-existing antibodies that can bind to a heavy-chain variable domain with a C-terminal extension have been found, by the present inventors, to be present in blood or serum samples obtained from human subjects suffering from certain (auto-) immune diseases or disorders that severely impact/activate the immune system (such as SLE).

Thus, more in particular, the purpose of the present invention is to provide improved heavy-chain immunoglobulin variable domains (and in particular improved heavy-chain ISVD's and more in particular improved nanobodies) that, when they have an exposed C-terminal region or end, are less prone to binding by pre-existing antibodies/factors, such as those that are found in blood or serum samples obtained from human subjects suffering from certain (auto-) immune diseases or disorders that severely impact/activate the immune system (such as SLE).

Even more in particular, the purpose of the present invention is to provide improved heavy-chain immunoglobulin variable domains (and in particular improved heavy-chain ISVD's and more in particular improved nanobodies) that, when they have an exposed C-terminal region or end, are less prone to binding by those pre-existing antibodies/factors that are found in blood or serum samples obtained from human subjects suffering from certain (auto-) immune diseases or disorders and that can still bind to the exposed C-terminal region or end of the VH domain when the VH domain comprises a C-terminal extension.

It has now been found that the binding of pre-existing antibodies/factors to a heavy-chain variable domain with an exposed C-terminal end can be (further) reduced by a mutation of the serine at position 112 (Kabat numbering) to either lysine (K) or glutamine (Q). In particular, it has been found that such an S112K or S112Q mutation can (further) reduce or essentially prevent/remove binding of pre-existing antibodies/factors that can bind to a heavy-chain variable domain that comprises a C-terminal extension (but no S112K or S112Q mutation), such as those pre-existing antibodies/factors that are found in the blood or serum of human subjects suffering from severe auto-immune disorders such as SLE.

It has also been found that introducing the specific mutations disclosed herein (and in particular the following mutations L11V in combination with V89L, and optionally further in combination with T110K) may improve, or contribute to a (further) improvement of, the solubility of immunoglobulin single variable domains, such as the ISVD's generally and specifically disclosed herein (data not shown).

Thus, in a first aspect, the invention relates to an immunoglobulin heavy-chain variable domain (VH domain) in which the amino acid residue at position 112 (Kabat numbering) is either a lysine (K) residue or a glutamine (Q) residue. Such an immunoglobulin heavy-chain variable domain is also referred to herein as a "VH domain of the invention". When a VH domain of the invention is an immunoglobulin single variable domain (as is preferred), it will also be referred to herein as an "ISVD of the invention". Similarly, when the VH domain of the invention is a Nanobody (as is even more preferred), it will also be referred to herein as a "Nanobody of the invention".

Generally, the VH domains of the invention either have an exposed C-terminal end or region, and/or are present in a protein, polypeptide, compound, entity or construct in which they have an exposed C-terminal end or region, and/or are intended for a use in which they have an exposed C-terminal region (for example, for use in in a protein, polypeptide, compound, entity or construct in which they are intended to form the C-terminal end or region).

In one aspect of the invention, the VH domain of the invention is an (heavy-chain) immunoglobulin single variable domain, meaning a heavy-chain variable domain that can form a functional antigen binding site without interaction with a VL domain. For example, the VH domain of the invention can be a Nanobody (including a VHH, a humanized VHH and/or a camelized VHs such as camelized human VH's), a (single) domain antibody that is a VH domain or that is derived from a VH domain, or a dAb that is a VH domain or that is derived from a VH domain. The VH domain of the invention is preferably a nanobody (e.g. a VHH domain, a humanized VHH domain or a camelized VH domain such as a camelized human VH domain).

According to another aspect of the invention, the VH domain of the invention can be a heavy-chain variable domain that, in the protein, polypeptide, protein or construct in which is it present, does require an interaction with a VL domain in order to form an antigen binding site and that does have or form an exposed C-terminal end or region. For example, a VH domain according to this aspect of the invention can be a VH domain that is present in and/or used in an ScFv and or a diabody.

According to a more specific aspect of the invention, the VH domain of the invention has a C-terminal sequence (positions 109 to 113 according to Kabat) that is VTVKS (SEQ ID NO:1) or VTVQS (SEQ ID NO:2), or a sequence that has one amino acid difference (i.e. at one of the positions 109, 110, 111 or 113) with either the sequence VTVKS and/or VTVQS and that still has either a lysine (K) or glutamine (Q) at position 112.

Also, as further described herein, in one particularly preferred aspect of the invention, the VH domain of the invention also contains a C-terminal extension (e.g. as described in WO 12/175741 and/or in WO 13/024059) at its C-terminal end (i.e. linked to the serine residue at the end of the VTVKS-, VTVQS- or similar motif), in particular a C-terminal extension that is as further defined herein. However, as also further described herein, it is also possible that the VTVKS-, VTVQS- or similar motif forms the C-terminal end of the VH domain (although this will usually be less preferred) or that the VH domain of the invention is linked at its C-terminal end (optionally via a suitable linker) to another amino acid sequence, moiety, domain or binding unit. For example, when the VH domain of the invention is an ISVD, the VH domain may be linked at its C-terminal end to another ISVD, optionally via a linker (and said other ISVD may then also be a VH domain of the invention).

Overall, as is well known for immunoglobulin variable domains generally, the VH domains of the invention will comprise 4 framework regions (FW1, FW2, FW3 and FW4) and 3 CDR's (CDR1, CDR2 and CDR3). As with immunoglobulin variable domains generally, the sequence of the CDR's will depend on the antigen/target(s) to which the VH domains of the invention have been raised and/or are intended to bind. The framework regions can generally be any suitable framework regions for VH domains (albeit that position 112 and/or position 89 will be as further described herein). If the VH domain of the invention is an ISVD, the VH domain will have framework sequences that are suitable for an ISVD (optionally in association with one or more of the CDR's). For example, if the VH domain of the invention is a Nanobody, the framework regions will generally contain a suitable number of VHH hallmark residues (for which reference is for example made to WO 08/020079 and to some of the other patent applications of applicant/assignee cited herein).

Thus, for example, when the VH domains of the invention are Nanobodies, said Nanobodies of the invention can contain one or more of the "Hallmark residues" that are characteristic of VHH's/Nanobodies (e.g. at positions 11, 37, 44, 45, 47, 83, 84, 103, 104 and/or 108; see for example Tables A-3 and A-5 to A-8 of WO 08/020079); one or more other amino acid residues that can be present in VHH's/Nanobodies (such as one or more humanizing substitutions that are known per se for VHH's and Nanobodies; reference is for example made to the teaching in WO 08/020079; see again the previously mentioned Tables A-3 and A-5 to A-8) and/or one or more other suitable amino acid residues or substitutions for VHH's/Nanobodies; or any suitable combination of such amino acid residues/substitutions.

Nanobodies of the invention in which position 112 is K or Q (i.e. with or without a C-terminal extension) preferably contain an amino acid at position 11 that is chosen from L (the most often occurring amino acid residue in VHH's), E, K, M, S, V, W or Y; more preferably from L, E, K, V or Y, and even more preferably from L, K or V (with V being most preferred). For example and without limitation, compared to the leucine residue that most often occurs in VHH's, they can contain an L11K or L11V mutation. They can also, but without limitation, for example contain a Q108L mutation (a well-known humanizing substitution for VHH's/Nanobodies). Other amino acid residues that can be present (again, without limitation, and for example other amino acid residues that naturally occur at this position in human VH's or VHH's may also be present at these positions) are for example one or more of an alanine (A) at position 14 (which is a very frequently occurring amino acid residue at this position in naturally occurring VHH's), a proline at position 14 (which is the most common amino acid at this position in human VH domains), as well as the mutations suggested by Harmsen et al. (in particular, those that Harmsen et al suggest based on the sequence of VHH4-class VHH's, such as V89M or V89T) and/or (other) mutations at the positions suggested by Nieba (for example, at one or more of positions 11, 87 and/or 89, see Nieba, page 437, right hand column). Another suitable mutation is for example T110K or T110Q. Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) Also, position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A)

According to a more specific aspect of the invention, a VH domain of the invention (which is as further described herein) has a framework 4 (FW4 sequence) that is either:

a) is one of the FW4 sequences of SEQ ID NO's: 3 to 20 mentioned in Table 1

TABLE 1

| FW4 sequences |
|---|
| WGQGTQVTVKS (SEQ ID NO: 3) |
| WGKGTLVTVKS (SEQ ID NO: 4) |
| RGQGTRVTVKS (SEQ ID NO: 5) |
| WGLGTQVTISS (SEQ ID NO: 6) |
| GSQGTQVTVKS (SEQ ID NO: 7) |
| LRGGTQVTVKS (SEQ ID NO: 8) |
| RGQGTLVTVKS (SEQ ID NO: 9) |
| RSRGIQVTVKS (SEQ ID NO: 10) |
| WGKGTQVTVKS (SEQ ID NO: 11) |
| WGQGTQVTVQS (SEQ ID NO: 12) |
| WGKGTLVTVQS (SEQ ID NO: 13) |
| RGQGTRVTVQS (SEQ ID NO: 14) |
| WGLGTQVTISS (SEQ ID NO: 15) |
| GSQGTQVTVQS (SEQ ID NO: 16) |
| LRGGTQVTVQS (SEQ ID NO: 17) |

TABLE 1-continued

| FW4 sequences |
|---|
| RGQGTLVTVQS (SEQ ID NO: 18) |
| RSRGIQVTVQS (SEQ ID NO: 19) |
| WGKGTQVTVQS (SEQ ID NO: 20) |

or:

b) is a sequence that has no more than three, preferably no more than two amino acid differences with at least one of the FW4 sequences of SEQ ID NO's 3 to 20, in which (i) the amino acid residue at the position corresponding to position 112 of the Kabat numbering is either K or Q; and in which (ii) the amino acid residue at the position corresponding to position 103 of the Kabat numbering is preferably W or R; (iii) the amino acid residue at the position corresponding to position 104 of the Kabat numbering is preferably G; (iv) the amino acid residue at the position corresponding to position 106 of the Kabat numbering is preferably G; (v) the amino acid residue at the position corresponding to position 107 of the Kabat numbering is preferably T; (vi) the amino acid residue at the position corresponding to position 108 of the Kabat numbering is preferably Q or L (and in humanized nanobodies preferably L); (vii) the amino acid residue at the position corresponding to position 109 of the Kabat numbering is preferably V; (viii) the amino acid residue at the position corresponding to position 110 of the Kabat numbering is preferably T (or alternatively may be K or Q); (ix) the amino acid residue at the position corresponding to position 111 of the Kabat numbering is preferably V. Table 2 below gives some non-limiting examples of amino acid residues that can be present at the different positions (numbered according to Kabat) of such FW4 sequences.

TABLE 2

Examples of amino acid residues that can be present in the FW4 sequences of the VH domains of the invention.

| Pos. | Amino acid residue(s): |
|---|---|
| 103 | W, R, G, S, K, A, M, Y, L, F, T, N, V, Q, P, E, C; preferably W |
| 104 | G, A, S, T, D, P, N, E, C, L; preferably G |
| 105 | Q, K, H, R, P, E, L, T, N, S, V, A, M, G |
| 106 | G, R, E |
| 107 | T, Q, I, A, S, N, R, V, D |
| 108 | Q, L, R, P, E, K, S, T, M, A, H; preferably Q or L |
| 109 | V, I, L |
| 110 | T, S, N, A, I, F, K, Q |
| 111 | V, I, A |
| 112 | K or Q (invention) |
| 113 | S, T, A, L, P, F, E, V |

Preferably, the VH domain of the invention has a framework 4 (FW4 sequence) that is either:

a) WGQGTQVTVKS (SEQ ID NO:3) or WGQGTQVTVQS (SEQ ID NO:12); or b) a sequence that has no more than three, preferably no more than two amino acid differences (such as only one amino acid difference) with SEQ ID NO:3 and/or SEQ ID NO: 12, in which (i) the amino acid residue at the position corresponding to position 112 of the Kabat numbering is either K or Q; and in which (ii) the amino acid residue at the position corresponding to position 103 of the Kabat numbering is preferably W or R; (iii) the amino acid residue at the position corresponding to position 104 of the Kabat numbering is preferably G; (iv) the amino acid residue at the position corresponding to position 106 of the Kabat numbering is preferably G; (v) the amino acid residue at the position corresponding to position 107 of the Kabat numbering is preferably T; (vi) the amino acid residue at the position corresponding to position 108 of the Kabat numbering is preferably Q or L (and in humanized nanobodies preferably L); (vii) the amino acid residue at the position corresponding to position 109 of the Kabat numbering is preferably V; (viii) the amino acid residue at the position corresponding to position 110 of the Kabat numbering is preferably T (or alternatively may be K or Q); (ix) the amino acid residue at the position corresponding to position 111 of the Kabat numbering is preferably V. Again, Table 2 gives some non-limiting examples of amino acid residues that can be present at the different positions (numbered according to Kabat) of such FW4 sequences.

As described further herein, according to a preferred aspect of the invention, VH domains of the invention that comprise a FW4 sequence as described above preferably also contains a C-terminal extension (as further described herein). However, as also further described herein, it is also possible that the FW4 sequence forms the C-terminal end of the VH domain (although this will usually be less preferred) or that the VH domain of the invention is linked at its C-terminal end (optionally via a suitable linker) to another amino acid sequence, moiety, domain or binding unit. For example, when the VH domain of the invention is an ISVD, the VH domain may be linked at its C-terminal end to another ISVD, optionally via a linker (and said other ISVD may then also be a VH domain of the invention).

As indicated herein, according to a preferred but non-limiting aspect of the invention, the VH domains of the invention contain a C-terminal extension, such as a C-terminal extension that is as described in WO 12/175741 and/or in WO 13/024059, and in particular as described in WO 12/175741

Thus, according to this aspect, the VH domain of the invention is an immunoglobulin heavy-chain variable domain (VH domain) in which: (i) the amino acid residue at position 112 (Kabat numbering) is not a serine residue, and is preferably either a lysine (K) residue or a glutamine (Q) residue; and that (ii) at its C-terminal end (i.e. linked to the amino acid residue at position that is or corresponds to position 113 according to the Kabat numbering) is linked to a further amino acid sequence (i.e. the “C-terminal extension”) that comprises between 1 and 5 (such as 1, 2, 3, 4 or 5, and preferably 1, 2 or 3, and most preferably only 1 or 2 such as only 1) amino acid residues that are each independently chosen from suitable amino acid residues, and preferably each independently chosen from naturally occurring amino acids, and more preferably each independently chosen from the group consisting of alanine (A), glycine (G), valine (V), leucine (L) or isoleucine (I) (however, as can be seen from the data presented in WO 12/17574, other amino acid residues such as serine, proline, threonine and/or lysine can also be used as part of the C-terminal extension).

In particular, according to this aspect of the invention, the VH domain of the invention preferably has a C-terminal sequence that is VTVKS(X)n (SEQ ID NO:21) or VTVQS (X)n (SEQ ID NO:22) (or that is an amino acid sequence that, at the positions of the VTVKS motif or the VTVQS-motif, has one amino acid difference with either the sequence VTVKS and/or VTVQS and that still has either a lysine (K) or glutamine (Q) at position 112), in which (i) the amino acid residues of the VTVKS- or VTVQS-motif (or VTVKS- or VTVQS-like motif) correspond to positions 109 to 113 of the VH domain according to the Kabat numbering; (ii) n is 1 to 10, preferably 1 to 5, such as 1, 2, 3, 4 or 5 (and preferably 1 or 2, such as 1); and (iii) each X is an (preferably naturally occurring) amino acid residue that is independently chosen, and preferably independently chosen from the group consisting of alanine (A), glycine (G), valine (V), leucine (L) or isoleucine (I).

More in particular, according to this aspect of the invention, the VH domain of the invention may have, as its FW4 sequence, one of the FW4 sequences of SEQ ID NO’s 3 to 20 (or an amino sequence that has no more than three, preferably no more than two amino acid differences with at least one of the FW4 sequences of SEQ ID NO’s 3 to 20, in which the amino acid residue at the position corresponding to position 112 of the Kabat numbering is either K or Q), in which said FW 4 sequence is linked, at its C-terminal end, to a C-terminal extension $(X)_n$, in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I).

Accordingly, in this aspect of the invention, a VH domain of the invention may have, at its C-terminal end, either:

a) one of the amino acid sequences given as SEQ ID NO’s: 23 to 40 in Table 3;

TABLE 3

| FW4 sequences with C-terminal extension |
|---|
| WGQGTQVTVKS$(X)_n$ (SEQ ID NO: 23) |
| WGKGTLVTVKS$(X)_n$ (SEQ ID NO: 24) |
| RGQGTRVTVKS$(X)_n$ (SEQ ID NO: 25) |
| WGLGTQVTISS$(X)_n$ (SEQ ID NO: 26) |
| GSQGTQVTVKS$(X)_n$ (SEQ ID NO: 27) |
| LRGGTQVTVKS$(X)_n$ (SEQ ID NO: 28) |
| RGQGTLVTVKS$(X)_n$ (SEQ ID NO: 29) |
| RSRGIQVTVKS$(X)_n$ (SEQ ID NO: 30) |
| WGKGTQVTVKS$(X)_n$ (SEQ ID NO: 31) |
| WGQGTQVTVQS$(X)_n$ (SEQ ID NO: 32) |
| WGKGTLVTVQS$(X)_n$ (SEQ ID NO: 33) |
| RGQGTRVTVQS$(X)_n$ (SEQ ID NO: 34) |
| WGLGTQVTISS$(X)_n$ (SEQ ID NO: 35) |
| GSQGTQVTVQS$(X)_n$ (SEQ ID NO: 36) |
| LRGGTQVTVQS$(X)_n$ (SEQ ID NO: 37) |
| RGQGTLVTVQS$(X)_n$ (SEQ ID NO: 38) |
| RSRGIQVTVQS$(X)_n$ (SEQ ID NO: 39) |
| WGKGTQVTVQS$(X)_n$ (SEQ ID NO: 40) |

in which (i) the amino acid residues of the FW4 sequences that precede the $(X)_n$ C-terminal extension in SEQ ID NO's: 23 to 40 correspond to the amino acid positions of FW4 of a VH domain (i.e. positions 103 to 113 according to the Kabat numbering); (ii) n is 1 to 10, preferably 1 to 5, such as 1, 2, 3, 4 or 5 (and preferably 1 or 2, such as 1); and (iii) each X is an (preferably naturally occurring) amino acid residue that is independently chosen, and preferably independently chosen from the group consisting of alanine (A), glycine (G), valine (V), leucine (L) or isoleucine (I); or b) an amino acid sequence that has no more than three, preferably no more than two, amino acid differences with at least one of the amino acid sequences SEQ ID NO's 23 to 40 (in which said amino acid differences are at the positions that correspond to the amino acid positions of FW4 of a VH domain, i.e. at positions 103 to 113 according to the Kabat numbering, with any amino acid differences within the C-terminal extension $(X)_n$ being disregarded), in which: (i) the amino acid residue at the position corresponding to position 112 of the Kabat numbering is either K or Q; (ii) n is 1 to 10, preferably 1 to 5, such as 1, 2, 3, 4 or 5 (and preferably 1 or 2, such as 1); and (iii) each X is an (preferably naturally occurring) amino acid residue that is independently chosen, and preferably independently chosen from the group consisting of alanine (A), glycine (G), valine (V), leucine (L) or isoleucine (I). Again, further to features (i) to (iii) as mentioned in the previous sentence, in such an amino acid sequence: (iv) the amino acid residue at the position corresponding to position 103 of the Kabat numbering is preferably W or R; (v) the amino acid residue at the position corresponding to position 104 of the Kabat numbering is preferably G; (vi) the amino acid residue at the position corresponding to position 106 of the Kabat numbering is preferably G; (vii) the amino acid residue at the position corresponding to position 107 of the Kabat numbering is preferably T; (viii) the amino acid residue at the position corresponding to position 108 of the Kabat numbering is preferably Q or L (and in humanized nanobodies preferably L); (ix) the amino acid residue at the position corresponding to position 109 of the Kabat numbering is preferably V; (x) the amino acid residue at the position corresponding to position 110 of the Kabat numbering is preferably T (or alternatively may be K or Q); (xi) the amino acid residue at the position corresponding to position 111 of the Kabat numbering is preferably V; and reference is again made to the Table 2 for possible amino acid residues that can be present at each position.

Preferably, according to this aspect of the invention, a VH domain of the invention has, at its C-terminal end, either:

a) an amino acid sequence that is WGQGTQVTVKS(X)n (SEQ ID NO:23) or WGQGTQVTVQS(X)n (SEQ ID NO:32), in which (ii) n is 1 to 10, preferably 1 to 5, such as 1, 2, 3, 4 or 5 (and preferably 1 or 2, such as 1); and (iii) each X is an (preferably naturally occurring) amino acid residue that is independently chosen, and preferably independently chosen from the group consisting of alanine (A), glycine (G), valine (V), leucine (L) or isoleucine (I); or b) an amino acid sequence that has no more than three, preferably no more than two, amino acid differences with at least one of the amino acid sequences WGQGTQVTVKS(X)n (SEQ ID NO:23) or WGQGTQVTVQS(X)n (SEQ ID NO:32) (in which said amino acid differences are at the positions that correspond to the amino acid positions of FW4 of a VH domain, i.e. at positions 103 to 113 according to the Kabat numbering, with any amino acid differences within the C-terminal extension $(X)_n$ being disregarded), in which: (i) the amino acid residue at the position corresponding to position 112 of the Kabat numbering is either K or Q; (ii) n is 1 to 10, preferably 1 to 5, such as 1, 2, 3, 4 or 5 (and preferably 1 or 2, such as 1); and (iii) each X is an (preferably naturally occurring) amino acid residue that is independently chosen, and preferably independently chosen from the group consisting of alanine (A), glycine (G), valine (V), leucine (L) or isoleucine (I). Again, for such amino acid sequences, features (vi) to (xi) as described in the preceding paragraphs preferably also apply.

Also, as mentioned herein, the VH domains of the invention can also contain other amino acid residues or substitutions that are known per se in the art for VH domains and in particular for ISVD's (and more in particular for Nanobodies) at the relevant positions. Some non-limiting examples may be as mentioned herein and for example include one or more of the "Hallmark residues" that are characteristic of VHH's/Nanobodies (including for example a leucine (L) at position 11), other amino acid residues that naturally occur in VHH's (such as an alanine (A) at position 14), humanizing substitutions known per se for VHH's/Nanobodies (such as Q108L and A14P), one or more of the mutations suggested by Harmsen (such as V89M or V89T) and/or at the positions suggested by Nieba (e.g. 11, 87 or 89); or any suitable combination thereof; and/or for example a T110K, T110Q or V89L mutation.

When a VH domain of the invention contains a C-terminal extension $(X)_n$, according to some preferred, but non-limiting examples of such extensions, X and n can be as follows:

(a) n=1 and X=Ala;
(b) n=2 and each X=Ala;
(c) n=3 and each X=Ala;
(d) n=2 and at least one X=Ala (with the remaining amino acid residue(s) X being independently chosen from any naturally occurring amino acid but preferably being independently chosen from Val, Leu and/or Ile);
(e) n=3 and at least one X=Ala (with the remaining amino acid residue(s) X being independently chosen from any naturally occurring amino acid but preferably being independently chosen from Val, Leu and/or Ile);
(f) n=3 and at least two X=Ala (with the remaining amino acid residue(s) X being independently chosen from any naturally occurring amino acid but preferably being independently chosen from Val, Leu and/or Ile);
(g) n=1 and X=Gly;
(h) n=2 and each X=Gly;
(i) n=3 and each X=Gly;
(j) n=2 and at least one X=Gly (with the remaining amino acid residue(s) X being independently chosen from any naturally occurring amino acid but preferably being independently chosen from Val, Leu and/or Ile);
(k) n=3 and at least one X=Gly (with the remaining amino acid residue(s) X being independently chosen from any naturally occurring amino acid but preferably being independently chosen from Val, Leu and/or Ile);
(l) n=3 and at least two X=Gly (with the remaining amino acid residue(s) X being independently chosen from any naturally occurring amino acid but preferably being independently chosen from Val, Leu and/or Ile);
(m) n=2 and each X=Ala or Gly;
(n) n=3 and each X=Ala or Gly;
(o) n=3 and at least one X=Ala or Gly (with the remaining amino acid residue(s) X being independently chosen from any naturally occurring amino acid but preferably being independently chosen from Val, Leu and/or Ile); or (p) n=3 and at least two X=Ala or Gly (with the remaining amino acid residue(s) X being independently chosen from any naturally occurring amino acid but preferably being independently chosen from Val, Leu and/or Ile);

with aspects (a), (b), (c), (g), (h), (i), (m) and (n) being particularly preferred, with aspects in which n=1 or 2 being preferred and aspects in which n=1 being particularly preferred.

It should also be noted that, preferably, any C-terminal extension present in a VH domain of the invention does not contain a (free) cysteine residue (unless said cysteine residue is used or intended for further functionalization, for example for pegylation).

Also, the preferences that are indicated on pages 35 to 41 of WO 12/175741 for the C-terminal extensions used according to WO 12/175741 (which are also the preferred C-terminal extensions used in the VH domains according to the present invention) also apply to the C-terminal extensions used in the VH domains of the inventions, and these preferences according to WO 12/175741 are also included herein by reference.

Preferably, when a VH domain of the invention contains a C-terminal extension $(X)_n$, n=1, 2 or 3, and each X is either Ala of Gly. More preferably, each X is Ala, and n=1 or 2, and preferably 1.

When the VH domains of the invention contain a C-terminal extension, they will usually be present at (and often form) the C-terminal end of the protein, polypeptide, compound, construct or other chemical entity in which it is present. Again, such a protein, polypeptide, compound, construct or other chemical entity may contain one or more other VH domains of the invention (i.e. not at the C-terminal end); in such a case, said other VH domains of the invention will contain a lysine (K) or glutamine (Q) at position 112 (and be as further described herein), but will not contain a C-terminal extension (instead, they may be linked (optionally via one or more suitable linkers) at their C-terminus to one or more other amino acid sequences, moieties, binding domains or binding units present in the protein, polypeptide, compound, construct or other chemical entity, such as the VH domain of the invention with the C-terminal extension that is present at the C-terminal end).

As the VH domains of the invention (and the proteins, polypeptides, compounds, constructs and other chemical entities comprising the same as further described herein) are particularly useful in (and intended for) use pharmaceutical uses (such as the prevention, treatment and/or diagnosis of diseases and disorders in human subjects in need of the same), they preferably have a high degree of sequence homology in their framework regions with the framework sequences of human VH domains. In particular, the VH domains of the invention preferably have an overall degree of sequence identity (determined as further described herein, and taking into account only the framework regions and not the CDR's, and also not taking into account the substitution at position 112 and any C-terminal extension if present) with at least one human germline sequence (such as DP-47, DP-51 or DP-29) of at least 80%, preferably at least 85%, such as 90% or more. More in particular, the VH domains of the invention preferably have an overall degree of sequence identity (determined as further described herein, and taking into account only the framework regions and not the CDR's, and also not taking into account the substitution at position 112 and any C-terminal extension if present) of at least 80%, preferably at least 85%, such as 90% or more with at least one of the following human germline sequences: DP-47, DP-51 and/or DP-29.

As further described herein, according to one aspect of the invention, the VH domain of the invention can be a heavy-chain variable domain that, in the protein, polypeptide, protein or construct in which is it present, interacts/associates (or is intended to interact/associate) with a VL domain in order to form an antigen binding site, in which at least the VH domain has an exposed C-terminal end or region. For example, a VH domain according to this aspect of the invention can be a VH domain that is present and/or used in an ScFv and or a diabody, where it will associate with a VL domain to form an antigen binding site.

However, according to a preferred aspect of the invention, the VH domain of the invention is an (heavy-chain) immunoglobulin single variable domain or "ISVD", meaning a heavy-chain variable domain that can form a functional antigen binding site without interaction with a VL domain. For example, the VH domain of the invention can be a Nanobody (including a VHH, a humanized VHH and/or a camelized VHs such as camelized human VH's), a (single domain) antibody is a VH domain or that is derived from a VH domain, or a dAb that is a VH domain or that is derived from a VH domain. The VH domain of the invention is preferably a nanobody (and more preferably VHH domain, a humanized VHH domain or a camelized VH domain such as a camelized human VH domain).

In the present specification:

the term "Nanobody" is generally as defined in or WO 08/020079 or WO 09/138519, and thus in a specific aspect generally denotes a VHH, a humanized VHH or a camelized VH (such as a camelized human VH) or generally a sequence optimized VHH (such as e.g. optimized for chemical stability and/or solubility, maximum overlap with known human framework regions and maximum expression). It is noted that the terms Nanobody or Nanobodies are registered trademarks of Ablynx N.V. and thus may also be referred to as Nanobody® and/or Nanobodies®);

the term "ISVD" (or "ISV") as used herein in its broadest sense also includes "ISVD-based biologicals" and, when the ISVD is a Nanobody, "Nanobody-based biologicals". An "ISVD-based biological" is defined herein as a protein, polypeptide or other biological drug that comprises or essentially consist of at least one (such as one, two or three) ISVD's. Similarly, a "Nanobody-based biological" is defined as a protein, polypeptide or other biological drug that comprises or essentially consist of at least one (such as one, two or three) Nanobodies. As with the term "ISVD", whenever the term "ISVD-based biological" is used, it should be understood that such an ISVD-based biological is preferably a Nanobody-based biological. Within the context of the present invention, both an "ISVD-based biological" and a "Nanobody-based biological" may for example be a monovalent, bivalent (or multivalent), bispecific (or multispecific), and biparatopic (or "multiparatopic) ISVD construct or Nanobody construct, respectively. Also, any ISVD-based or Nanobody-based biological may for example, in addition to the one or more (such as one, two or three) ISVD's or Nanobodies, optionally further comprise one or more (such as one or two) other further therapeutic moieties and/or one or more (such as one or two) other moieties that influence the pharmacokinetic or pharmacodynamic properties of the ISVD-based or Nanobody-based biological (such as its half-life). Suitable examples of such further therapeutic or other moieties will be clear to the skilled person, and for example generally can include any therapeutically active protein, polypeptide or other binding domain or binding unit, as well as for example modifications such as those described on pages 149 to 152 of WO 09/138159. An ISVD-based biological or Nanobody-based biological is preferably a therapeutic or intended for use as a therapeutic (which includes prophylaxis and diagnosis) and for this purpose preferably contains at least one ISVD against a therapeutically relevant target (such as for example RANK-L, vWF, IgE, RSV, CXCR4, IL-23 or other interleukins, etc.). For some specific but non-limiting examples of such ISVD-based or Nanobody-based biologicals, reference is to Examples 8 to 18 and also for example made to the various applications by Ablynx N.V. (such as for example and without limitation WO 2004/062551, WO 2006/122825, WO 2008/020079 and WO 2009/068627), as well as for example (and without limitation) to applications such as WO 06/038027, WO 06/059108, WO 07/063308, WO 07/063311, WO 07/066016 and WO 07/085814. Also, as further described herein, an ISVD or Nanobody as described herein may be directed against a (human) serum protein such as (human) serum albumin, and such an ISVD or Nanobody may also find therapeutic uses, in particular in and/or for extending the half-life of therapeutic moieties and compounds (such as in or for the ISV-based biologicals described herein). Reference is for example made to WO 2004/041865, WO 2006/122787 and WO 2012/175400, which generally describe the use of serum-albumin binding nanobodies for half-life extension. Also, in the present specification, unless explicitly mentioned otherwise herein, all terms mentioned herein have the meaning given in WO 09/138519 (or in the prior art cited in WO 09/138519) or WO 08/020079 (or in the prior art cited in WO 08/020079). Also, where a method or technique is not specifically described herein, it can be performed as described in WO 09/138519 (or in the prior art cited in WO 09/138519) or WO 08/020079 (or in the prior art cited in WO 08/020079).

Also, when used in the present specification or claims, the following terms have the same meaning as given on, and/or where applicable can be determined in the manner described in, pages 62-75 of WO 09/138519: "agonist", "antagonist", "inverse agonist", "non-polar, uncharged amino acid residue", "polar uncharged amino acid residue", "polar, charged amino acid residue", "sequence identity", "exactly the same" and "amino acid difference" (when referring to a sequence comparison of two amino acid sequences), "(in) essentially isolated (form)", "domain", "binding domain", "antigenic determinant", "epitope", "against" or "directed against" (an antigen), "specificity" and "half-life". In addition, the terms "modulating" and "to modulate", "interaction site", "specific for", "cross-block", "cross-blocked" and "cross-blocking" and "essentially independent of the pH" are as defined on (and/or can be determined as described on) pages 74-79 of WO 10/130832 of applicant. Also, when referring to a construct, compound, protein or polypeptide of the invention, terms like "monovalent", "bivalent" (or "multivalent"), "bispecific" (or "multispecific"), and "biparatopic" (or "multiparatopic") may have the meaning given in WO 09/138.519, WO 10/130832 or WO 08/020079.

The term "half-life" as used herein relation to an ISVD, Nanobody, ISVD-based biological, Nanobody-based biological or any other amino acid sequence, compound or polypeptide referred to herein can generally be defined as described in paragraph o) on page 57 of WO 08/020079 and as mentioned therein refers to the time taken for the serum concentration of the amino acid sequence, compound or polypeptide to be reduced by 50%, in vivo, for example due to degradation of the sequence or compound and/or clearance or sequestration of the sequence or compound by natural mechanisms. The in vivo half-life of an amino acid sequence, compound or polypeptide of the invention can be determined in any manner known per se, such as by pharmacokinetic analysis. Suitable techniques will be clear to the person skilled in the art, and may for example generally be as described in paragraph o) on page 57 of WO 08/020079. As also mentioned in paragraph o) on page 57 of WO 08/020079, the half-life can be expressed using parameters such as the t1/2-alpha, t1/2-beta and the area under the curve (AUC). In this respect it should be noted that the term "half-life" as used herein in particular refers to the t1/2-beta or terminal half-life (in which the t1/2-alpha and/or the AUC or both may be kept out of considerations). Reference is for example made to the Experimental Part below, as well as to the standard handbooks, such as Kenneth, A et al: Chemical Stability of Pharmaceuticals: A Handbook for Pharmacists and Peters et al, Pharmacokinete analysis: A Practical Approach (1996). Reference is also made to "Pharmacokinetics", M Gibaldi & D Perron, published by Marcel Dekker, 2nd Rev. edition (1982). Similarly, the terms "increase in half-life" or "increased half-life" as also as defined in paragraph o) on page 57 of WO 08/020079 and in particular refer to an increase in the t1/2-beta, either with or without an increase in the t1/2-alpha and/or the AUC or both.

When a term is not specifically defined herein, it has its usual meaning in the art, which will be clear to the skilled person. Reference is for example made to the standard handbooks, such as Sambrook et al, "Molecular Cloning: A Laboratory Manual" (2nd. Ed.), Vols. 1-3, Cold Spring Harbor Laboratory Press (1989); F. Ausubel et al, eds., "Current protocols in molecular biology", Green Publishing and Wiley Interscience, New York (1987); Lewin, "Genes II", John Wiley & Sons, New York, N.Y., (1985); Old et al., "Principles of Gene Manipulation: An Introduction to Genetic Engineering", 2nd edition, University of California Press, Berkeley, CA (1981); Roitt et al., "Immunology" (6th. Ed.), Mosby/Elsevier, Edinburgh (2001); Roitt et al., Roitt's Essential Immunology, 10th Ed. Blackwell Publishing, U K (2001); and Janeway et al., "Immunobiology" (6th Ed.), Garland Science Publishing/Churchill Livingstone, New York (2005), as well as to the general background art cited herein.

Also, as already indicated herein, the amino acid residues of a Nanobody are numbered according to the general numbering for VH domains given by Kabat et al. ("Sequence of proteins of immunological interest", US Public Health Services, NIH Bethesda, MD, Publication No. 91), as applied to VHH domains from Camelids in the article of Riechmann and Muyldermans, J. Immunol. Methods 2000 June 23; 240 (1-2): 185-195; or referred to herein. According to this numbering, FR1 of a Nanobody comprises the amino acid residues at positions 1-30, CDR1 of a Nanobody comprises the amino acid residues at positions 31-35, FR2 of a Nanobody comprises the amino acids at positions 36-49, CDR2 of a Nanobody comprises the amino acid residues at positions 50-65, FR3 of a Nanobody comprises the amino acid residues at positions 66-94, CDR3 of a Nanobody comprises the amino acid residues at positions 95-102, and FR4 of a Nanobody comprises the amino acid residues at positions 103-113. [In this respect, it should be noted that—as is well known in the art for VH domains and for VHH domains—the total number of amino acid residues in each of the CDR's may vary and may not correspond to the total number of amino acid residues indicated by the Kabat numbering (that is, one or more positions according to the Kabat numbering may not be occupied in the actual sequence, or the actual sequence may contain more amino acid residues than the number allowed for by the Kabat numbering). This means that, generally, the numbering according to Kabat may or may not correspond to the actual numbering of the amino acid residues in the actual sequence. Generally, however, it can be said that, according to the numbering of Kabat and irrespective of the number of amino acid residues in the CDR's, position 1 according to the Kabat numbering corresponds to the start of FR1 and vice versa, position 36 according to the Kabat numbering corresponds to the start of FR2 and vice versa, position 66 according to the Kabat numbering corresponds to the start of FR3 and vice versa, and position 103 according to the Kabat numbering corresponds to the start of FR4 and vice versa.].

Alternative methods for numbering the amino acid residues of VH domains, which methods can also be applied in an analogous manner to VHH domains from Camelids and to Nanobodies, are the method described by Chothia et al. (Nature 342, 877-883 (1989)), the so-called "AbM definition" and the so-called "contact definition". However, in the present description, aspects and figures, the numbering according to Kabat as applied to VHH domains by Riechmann and Muyldermans will be followed, unless indicated otherwise.

It should also be noted that the Figures, any Sequence Listing and the Experimental Part/Examples are only given to further illustrate the invention and should not be interpreted or construed as limiting the scope of the invention and/or of the appended claims in any way, unless explicitly indicated otherwise herein.

The VH domains of the invention can be directed against any suitable or desired antigen or target, including any pharmaceutically and/or therapeutically relevant target as described herein.

According to one specific aspect of the invention, the VH domains of the invention are directed against a serum protein, and in particular a human serum protein. According to a preferred aspect, when a VH domain of the invention is directed against a serum protein, it is directed against serum albumin, and in particular human serum albumin. Thus, the invention also relates to a VH domain of the invention (as defined herein, including the preferences defined for the VH domains of the invention) that can specifically bind to a serum protein, in particular a human serum protein, and that can preferably specifically bind to serum albumin, and more preferably to human serum albumin. Again, such a VH domain is preferably an ISVD (as described herein) and more preferably a Nanobody.

For example, a VH domain of the invention against serum albumin can be one of the Nanobodies against (human) serum albumin that are described in WO 2004/041865, and in particular in WO 2006/122787 and WO 2012/175400 (all applications from applicant/assignee), in which the amino acid at position 112 is substituted by either K or Q, and which is optionally provided with a C-terminal extension as described herein (and can also for example also contain one or more of the other specific amino acid residues/substitutions mentioned herein, such as 11L, L11V, L11K, 14A, P14A, 14P, A14P, 89T, V89T, 89L, V89L, 108L, Q108L, 110Q, T110Q, 110K and/or T110K; although usually the presence of an additional substitution at position 110 will not often not be required when position 112 is K or Q, in which case position 110 is preferably T). Furthermore, it is envisaged that the present invention can also be applied to other serum-albumin binding heavy-chain ISVD's, such as those described in WO 03/035694, WO 04/003019, WO 05/118642, WO 06/059106, WO 08/096158, WO 09/121804WO 10/108937 or US 2013/0129727, i.e. by suitably introducing the substitutions described herein (i.e. at least one of S112K, S112Q and/or V89T, and optionally one or more of the other amino acid residues/substitutions described herein, such as L11V) and optionally (and usually preferably as outlined herein) adding a C-terminal extension (as further described herein). Some preferred but non-limiting examples of such serum albumin binding Nanobodies of the invention are humanized variants of the amino acid sequence of SEQ ID NO: 52 of WO 2006/122787 (called "Alb-1" in WO 2006/122787), in which the amino acid at position 112 is substituted by either K or Q (and which is optionally provided with a C-terminal extension as described herein), such as the humanized variants of Alb-1 that are given in SEQ ID NO's: 57 to 64 of WO 2006/122787 (in each case, with a S112K or S112Q substitution, and optionally with a C-terminal extension) or the humanized variants of Alb-1 that are given in SEQ ID NO's 3 to 11 of WO 2012/175400 (again, in each case, with a S112K or S112Q substitution), of which SEQ ID NO's 3, 4 and 5 can optionally contain a C-terminal extension, and SEQ ID NO's 6 to 11 already contain a C-terminal extension (and again, such variants can contain one or more of the other specific amino acid residues/substitutions mentioned herein, such as 11L, L11V, L11K, 14A, P14A, 14P, A14P, 89T, V89T, 89L, V89L, 108L, Q108L, 110Q, T110Q, 110K and/or T110K; although usually the presence of an additional substitution at position 110 will not often not be required when position 112 is K or Q, in which case position 110 is preferably T). Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

Thus, in a further aspect, the invention relates to a Nanobody of the invention (as defined herein) that can bind (and in particular specifically bind) to serum albumin (and in particular human serum albumin) in which:

CDR1 is the amino acid sequence SFGMS (SEQ ID NO:41);

CDR2 is the amino acid sequence SISGSGSDTLYADSVKG (SEQ ID NO:42);

CDR3 is the amino acid sequence GGSLSR (SEQ ID NO:43);

the amino acid residue at position 112 is either K or Q; and that optionally contains at its C-terminal end a C-terminal extension $(X)_n$, in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I) (again, such a C-terminal extension is preferably as further described herein, and again such a Nanobody can also for example also contain one or more of the other specific amino acid residues/substitutions mentioned herein, such as 11L, L11V, L11K, 14A, P14A, 14P, A14P, 89T, V89T, 89L, V89L, 108L, Q108L, 110Q, T110Q, 110K and/or T110K; although usually the presence of an additional substitution at position 110 will not often not be required when position 112 is K or Q, in which case position 110 is preferably T). Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

In a particular aspect, the invention relates to a Nanobody of the invention (as defined herein) that can bind (and in particular specifically bind) to serum albumin (and in particular human serum albumin) that is a humanized variant of SEQ ID NO: 52 of WO 2006/122787 in which:

- CDR1 is the amino acid sequence SFGMS (SEQ ID NO:41);
- CDR2 is the amino acid sequence SISGSGSDTLYADSVKG (SEQ ID NO:42);
- CDR3 is the amino acid sequence GGSLSR (SEQ ID NO:43);
- the amino acid residue at position 112 is either K or Q;

and that optionally contains at its C-terminal end a C-terminal extension $(X)_n$ in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I) (again, such a C-terminal extension is preferably as further described herein, and again such a Nanobody can also for example also contain one or more of the other specific amino acid residues/substitutions mentioned herein, such as 11L, L11V, L11K, 14A, P14A, 14P, A14P, 89T, V89T, 89L, V89L, 108L, Q108L, 110Q, T110Q, 110K and/or T110K; although usually the presence of an additional substitution at position 110 will not often not be required when position 112 is K or Q, in which case position 110 is preferably T). Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

In a particular aspect, the invention relates to a Nanobody of the invention (as defined herein) that can bind (and in particular specifically bind) to serum albumin (and in particular human serum albumin) that has at least 80%, preferably at least 85%, more preferably at least 90% such as at least 95% sequence identity with at least one of Alb-1 (SEQ ID NO: 52 of WO 2006/122787), Alb-8 (SEQ ID NO: 46 herein) and/or Alb-23 (SEQ ID NO:61 herein) (taking into account both the framework sequences and the CDR's, but not any C-terminal extension), in which the amino acid residue at position 112 is either K or Q, and that optionally contains at its C-terminal end a C-terminal extension $(X)_n$ in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I) (again, such a C-terminal extension is preferably as further described herein, and again such a Nanobody can also for example also contain one or more of the other specific amino acid residues/substitutions mentioned herein, such as 11L, L11V, L11K, 14A, P14A, 14P, A14P, 89T, V89T, 89L, V89L, 108L, Q108L, 110Q, T110Q, 110K and/or T110K; although usually the presence of an additional substitution at position 110 will not often not be required when position 112 is K or Q, in which case position 110 is preferably T). Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

Such a Nanobody of the invention is again preferably a humanized variant of Alb-1 (but with a S112K or S112Q substitution), and more preferably has at least one, in particular any two, and more in particular all three of CDR1, CDR2 and/or CDR3 given in SEQ ID NO's 41 to 43, respectively.

According to one specific aspect, any serum albumin-binding Nanobody of the invention can also have the amino acid residues that are characteristic of Alb-23 and its variants as described in WO 12/175400 (i.e. the amino acid motif GP on positions 44 and 45, the amino acid motif SKN on positions 74 to 76, and preferably a G at position 16 and optionally also an R at position 83).

Some preferred, but non-limiting examples of Nanobodies of the invention that are directed against human serum albumin are given in Table 4 and Example 20.

TABLE 4

Non-limiting examples of VH domains of the invention directed against human serum albumin.

| SEQ ID: | Sequence name | Amino acid at position 112 | C-terminal extension | Sequence |
|---|---|---|---|---|
| 46 | Alb-11 (WO 06/122787) | S (reference) | [none] | EVQLVESGGGLVQPGNSLRLSCAASGFTFSSFGMSWVRQAPGKGLEWVS SISGSGSDTLYADSVKGRFTISRDNAKTTLYLQMNSLRPEDTAVYYCTI GGSLSRSSQGTLVTVSS |
| 47 | Alb-11 + 112K | K | [none] | EVQLVESGGGLVQPGNSLRLSCAASGFTFSSFGMSWVRQAPGKGLEWVS SISGSGSDTLYADSVKGRFTISRDNAKTTLYLQMNSLRPEDTAVYYCTI GGSLSRSSQGTLVTVKS |
| 48 | Alb-11 + 112K + A | K | A | EVQLVESGGGLVQPGNSLRLSCAASGFTFSSFGMSWVRQAPGKGLEWVS SISGSGSDTLYADSVKGRFTISRDNAKTTLYLQMNSLRPEDTAVYYCTI GGSLSRSSQGTLVTVKSA |
| 49 | Alb-11 + 112K + AA | K | AA | EVQLVESGGGLVQPGNSLRLSCAASGFTFSSFGMSWVRQAPGKGLEWVS SISGSGSDTLYADSVKGRFTISRDNAKTTLYLQMNSLRPEDTAVYYCTI GGSLSRSSQGTLVTVKSAA |
| 50 | Alb-11 + 112K + AAA | K | AAA | EVQLVESGGGLVQPGNSLRLSCAASGFTFSSFGMSWVRQAPGKGLEWVS SISGSGSDTLYADSVKGRFTISRDNAKTTLYLQMNSLRPEDTAVYYCTI GGSLSRSSQGTLVTVKSAAA |
| 51 | Alb-11 + 112K + G | K | G | EVQLVESGGGLVQPGNSLRLSCAASGFTFSSFGMSWVRQAPGKGLEWVS SISGSGSDTLYADSVKGRFTISRDNAKTTLYLQMNSLRPEDTAVYYCTI GGSLSRSSQGTLVTVKSG |
| 52 | Alb-11 + 112K + GG | K | GG | EVQLVESGGGLVQPGNSLRLSCAASGFTFSSFGMSWVRQAPGKGLEWVS SISGSGSDTLYADSVKGRFTISRDNAKTTLYLQMNSLRPEDTAVYYCTI GGSLSRSSQGTLVTVKSGG |
| 53 | Alb-11 + 112K + GGG | K | GGG | EVQLVESGGGLVQPGNSLRLSCAASGFTFSSFGMSWVRQAPGKGLEWVS SISGSGSDTLYADSVKGRFTISRDNAKTTLYLQMNSLRPEDTAVYYCTI GGSLSRSSQGTLVTVKSGGG |
| 54 | Alb-11 + 112Q | Q | [none] | EVQLVESGGGLVQPGNSLRLSCAASGFTFSSFGMSWVRQAPGKGLEWVS SISGSGSDTLYADSVKGRFTISRDNAKTTLYLQMNSLRPEDTAVYYCTI GGSLSRSSQGTLVTVQS |
| 55 | Alb-11 + 1120 + A | Q | A | EVQLVESGGGLVQPGNSLRLSCAASGFTFSSFGMSWVRQAPGKGLEWVS SISGSGSDTLYADSVKGRFTISRDNAKTTLYLQMNSLRPEDTAVYYCTI GGSLSRSSQGTLVTVQSA |
| 56 | Alb-11 + 1120 + AA | Q | AA | EVQLVESGGGLVQPGNSLRLSCAASGFTFSSFGMSWVRQAPGKGLEWVS SISGSGSDTLYADSVKGRFTISRDNAKTTLYLQMNSLRPEDTAVYYCTI GGSLSRSSQGTLVTVQSAA |
| 57 | Alb-11 + 1120 + AAA | Q | AAA | EVQLVESGGGLVQPGNSLRLSCAASGFTFSSFGMSWVRQAPGKGLEWVS SISGSGSDTLYADSVKGRFTISRDNAKTTLYLQMNSLRPEDTAVYYCTI GGSLSRSSQGTLVTVQSAAA |
| 58 | Alb-11 + 1120 + G | Q | G | EVQLVESGGGLVQPGNSLRLSCAASGFTFSSFGMSWVRQAPGKGLEWVS SISGSGSDTLYADSVKGRFTISRDNAKTTLYLQMNSLRPEDTAVYYCTI GGSLSRSSQGTLVTVQSG |
| 59 | Alb-11 + 1120 + GG | Q | GG | EVQLVESGGGLVQPGNSLRLSCAASGFTFSSFGMSWVRQAPGKGLEWVS SISGSGSDTLYADSVKGRFTISRDNAKTTLYLQMNSLRPEDTAVYYCTI GGSLSRSSQGTLVTVQSGG |
| 60 | Alb-11 + 112Q + GGG | Q | GGG | EVQLVESGGGLVQPGNSLRLSCAASGFTFSSFGMSWVRQAPGKGLEWVS SISGSGSDTLYADSVKGRFTISRDNAKTTLYLQMNSLRPEDTAVYYCTI GGSLSRSSQGTLVTVQSGGG |
| 61 | Alb-23 (WO 12/175400) | S (reference) | [none] | EVQLLESGGGLVQPGGSLRLSCAASGFTFRSFGMSWVRQAPGKGPEWVS SISGSGSDTLYADSVKGRFTISRDNSKNTLYLQMNSLRPEDTAVYYCTI GGSLSRSSQGTLVTVSS |

TABLE 4-continued

Non-limiting examples of VH domains of the invention directed against human serum albumin.

| SEQ ID: | Sequence name | Amino acid at position 112 | C-terminal extension | Sequence |
|---|---|---|---|---|
| 62 | Alb-23 + 112K | K | [none]<br>GGSLSR | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTISSQGTLVTVKS |
| 63 | Alb-23 + 112K +A | K | A | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVKSA |
| 64 | Alb-23 + 112K +AA | K | AA | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVKSAA |
| 65 | Alb-23 + 112K +AAA | K | AAA | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVKSAAA |
| 66 | Alb-23 + 112K + G | K | G | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVKSG |
| 67 | Alb-23 + 112K + GG | K | GG | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVKSGG |
| 68 | Alb-23 + 112K + GGG | K | GGG | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVKSGGG |
| 69 | Alb-23 + 112Q | Q | [none] | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVQS |
| 70 | Alb-23 + 112Q + A | Q | A | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVQSA |
| 71 | Alb-23 + 112Q + AA | Q | AA | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVQSAA |
| 72 | Alb-23 + 112Q + AAA | Q | AAA | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVQSAAA |
| 73 | Alb-23 + 112Q + G | Q | G | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVQSG |
| 74 | Alb-23 + 112Q + GG | Q | GG | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVQSGG |
| 75 | Alb-23 + 112Q + GGG | Q | GGG | EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVQSGGG |

In another aspect, the invention relates to a VH domain, and in particular an ISVD, and more in particular an Nanobody, that has:

a) a FW 4 sequence that is one of the following FW4 sequences:

TABLE 5

| FW4 sequences |
|---|
| SSQGTLVTVKS (SEQ ID NO: 99) |
| SSQGTLVTVQS (SEQ ID NO: 100) |

TABLE 5-continued

| FW4 sequences |
|---|
| SSQGTLVKVSS (SEQ ID NO: 101) |
| SSQGTLVQVSS (SEQ ID NO: 102) |
| SSQGTLVTVKS(X)$_n$ (SEQ ID NO: 103) |
| SSQGTLVTVQS(X)$_n$ (SEQ ID NO: 104) |

TABLE 5-continued

| FW4 sequences |
|---|
| SSQGTLVKVSS(X)$_n$ (SEQ ID NO: 105) |
| SSQGTLVQVSS(X)$_n$ (SEQ ID NO: 106) |

in which (i) the amino acid residues of the FW4 sequences that precede the (X)$_n$ C-terminal extension in SEQ ID NO's: 23 to 40 correspond to the amino acid positions of FW4 of a VH domain (i.e. positions 103 to 113 according to the Kabat numbering); (ii) n is 1 to 10, preferably 1 to 5, such as 1, 2, 3, 4 or 5 (and preferably 1 or 2, such as 1); and (iii) each X is an (preferably naturally occurring) amino acid residue that is independently chosen, and preferably independently chosen from the group consisting of alanine (A), glycine (G), valine (V), leucine (L) or isoleucine (I); or c) an amino acid sequence that has no more than three, preferably no more than two, amino acid differences with at least one of the amino acid sequences SEQ ID NO's: 99 to 106 (in which said amino acid differences are at the positions that correspond to the amino acid positions of FW4 of a VH domain, i.e. at positions 103 to 113 according to the Kabat numbering, with any amino acid differences within the C-terminal extension (X)$_n$ being disregarded), in which: (i) when the amino acid residue at the position corresponding to position 112 of the Kabat numbering is either K or Q, said amino acid differences are at another amino acid position than 112, and the amino acid residue at position 89 of the VH domain is preferably chosen from V, T or L (and is most preferably V); (i) when the amino acid residue at the position corresponding to position 110 of the Kabat numbering is either K or Q, then said amino acid differences are at another amino acid position than 110, and position 89 is the VH domain is L; (iii) n is 1 to 10, preferably 1 to 5, such as 1, 2, 3, 4 or 5 (and preferably 1 or 2, such as 1); and (iv) each X is an (preferably naturally occurring) amino acid residue that is independently chosen, and preferably independently chosen from the group consisting of alanine (A), glycine (G), valine (V), leucine (L) or isoleucine (I). Again, further to features (i) to (iv) as mentioned in the previous sentence, in such an amino acid sequence: (v) the amino acid residue at the position corresponding to position 103 of the Kabat numbering is preferably S; (vi) the amino acid residue at the position corresponding to position 104 of the Kabat numbering is preferably S; (vii) the amino acid residue at the position corresponding to position 106 of the Kabat numbering is preferably G; (viii) the amino acid residue at the position corresponding to position 107 of the Kabat numbering is preferably T; (ix) the amino acid residue at the position corresponding to position 108 of the Kabat numbering is preferably Q or L (and in humanized nanobodies preferably L); (ix) the amino acid residue at the position corresponding to position 109 of the Kabat numbering is preferably V; and reference is again made to the Table 2 for possible amino acid residues that can be present at each position.

Again, in such VH domains of the invention: (a) the amino acid residue at position 11 is one of L, V or K (and more preferably V); the amino acid residue at position 14 is preferably one of A or P; the amino acid residue at position 41 is preferably one of A or P. Also, such a VH domain of the invention is preferably an ISVD, and more preferably a Nanobody; and may again be directed against human serum albumin (in which case it preferably has CDR1, CDR2 and CDR3 respectively that correspond to SEQ ID NO's 41, 42 and 43, respectively). Also, when said VH domains are ISVD's or nanobodies against human serum albumin, they can further be as described herein for nanobodies of the invention that are directed against human serum albumin.

The VH domains of the invention that are directed against serum albumin (and in particular a serum-albumin binding ISVD of the invention) can be used to increase the half-life of therapeutically active compounds, (poly)peptides, proteins, binding domains, binding units or other therapeutically active entities or moieties, essentially in the manner described in WO 2004/041865, WO 2006/122787 and/or WO 2012/175400 for the use of the serum albumin-binding nanobodies that are disclosed in said references (i.e. by suitably linking the serum albumin-binding ISVD to the protein, polypeptide, compound or other entities, optionally via a suitable linker. For example, WO 12/175400 on pages 12 and 13 gives some examples of the manner in which suitable fusion proteins can be constructed).

In another aspect, the invention relates to an immunoglobulin heavy-chain variable domain (VH domain) in which the amino acid residue at position 89 (Kabat numbering) is threonine (T) and the amino acid residue at position 112 is either a serine (S), lysine (K) residue or glutamine (Q) residue. Such immunoglobulin heavy-chain variable domains (VH domain) with a T at position 89 are also included in the term "VH domains of the invention" as used herein in its broadest sense and can further be as described herein for the VH domains of the invention that comprise a K or Q at position 112. Accordingly, such an immunoglobulin heavy-chain variable domain (VH domain) can have a C-terminal extension as further described herein (including the indicated preferences for such a C-terminal extension); can be an ISVD and in particular a Nanobody as further described herein.

Again, if such an VH domain of the invention has an exposed C-terminal region (for example, because it forms the C-terminal end of the protein, polypeptide or other construct in which it is present), it preferably contains a C-terminal extension (reference is made to the data shown in Table C below).

Also, Nanobodies of the invention in which position 89 is T (i.e. with or without a C-terminal extension) preferably contain an amino acid at position 11 that is chosen from L (the most often occuring amino acid residue in VHH's), E, K, M, S, V, W or Y; more preferably from L, E, K, V or Y, and even more preferably from L, K or V (with V being most preferred). For example, they can contain an L11K or L11V substitution, as well as for example a P14A or A14P substitution, a Q108L substitution, and/or a T110K, T110Q, S112K and/or S112Q substitution (although usually the presence of one or two additional substitutions at position 110 and/or 112 will not often not be required when position 89 is T, in which case position 110 is preferably T and position 112 is preferably S).

In particular, an immunoglobulin heavy-chain variable domain (VH domain) of the invention according to this particular aspect has a T at position 89 (Kabat) and a C-terminal end that is one of VTVSS (SEQ ID NO:77), VTVSS(X)n (SEQ ID NO:78), VTVKS (SEQ ID NO:1), VTVKS(X)n (SEQ ID NO:21), VTVQS (SEQ ID NO:2), VTVQS(X)n (SEQ ID NO:22), VKVSS (SEQ ID NO: 95), VKVSS(X)n (SEQ ID NO:97), VQVSS (SEQ ID NO: 96), VQVSS(X)n (SEQ ID NO: 98), VZVZS (SEQ ID NO: 107, in which each amino acid residue Z is independently K or Q) or VZVZSX(n) (SEQ ID NO: 108, in which each amino acid residue Z is independently K or Q) (and in particular one of VTVKS (SEQ ID NO:1), VTVQS (SEQ ID NO:2), VTVSS (SEQ ID NO:77), VTVKS(X)n (SEQ ID NO:21), VTVQS $(X)_n$ (SEQ ID NO:22) or VTVSS$(X)_n$ (SEQ ID NO:78), and more in particular be either VTVSS (SEQ ID NO:77) or VTVSS(X)n (SEQ ID NO:78)), in which n and X are as further described herein for the VH domains of the invention in which position 112 is Q or K (and in which any C-terminal extension is preferably as further described herein for the VH domains of the invention in which position 112 is Q or K). Also, as is the case for the VH domains of the invention in which position 112 is Q or K, when such a VH domain with a T at position 89 is a nanobody, position 11 is preferably a leucine (L), position 14 can in particular be alanine (A) or proline (P) and position 108 can in particular be Q or L (and in humanized nanobodies preferably L); and such a Nanobody with a T at position 89 can contain one or more nanobody hallmark residues and/or can be suitably humanized. Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

Such a VH domain of the invention with a T at position 89 can again also be a serum albumin Nanobody as further described herein. For example, such a serum albumin-binding Nanobody can be one of the sequences of SEQ ID NOs: 46 to 75, but with a T at position 89; or another serum albumin binding Nanobody with a T at position 89 that has at least 80%, preferably at least 85%, more preferably at least 90% such as at least 95% sequence identity with at least one of Alb-1 (SEQ ID NO: 52 of WO 2006/122787), Alb-8 (SEQ ID NO: 46 herein) and/or Alb-23 (SEQ ID NO:61 herein) (taking into account both the framework sequences and the CDR's, but not any C-terminal extension). Some other examples of such Nanobodies with a T at position 89 are given in SEQ ID NO's: 78 to 91 (these are further variants of Alb-1/Alb-8 or Alb-23 with a T at position 89 and an S at position 112).

More generally, a VH domain against serum albumin according to this aspect of the invention can be one of the Nanobodies against (human) serum albumin that are described in WO 2004/041865, and in particular in WO 2006/122787 and WO 2012/175400 (all applications from applicant/assignee), in which the amino acid at position 89 is a threonine (T), and which is optionally provided with a C-terminal extension as described herein (and can also for example also suitably contain one or more of the other specific amino acid residues/substitutions mentioned herein, such as 11L, L11V, L11K, 14A, P14A, 14P, A14P, 108L, Q108L, 110K, T110K, 110Q, T110Q, S112K and/or S112Q; although usually the presence of additional substitutions at positions 110 and/or 112 will not often not be required when a T is present at position 89, in which case that position 110 is preferably T and position 112 is preferably S). Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A). Furthermore, it is envisaged that the present invention can also be applied other serum-albumin binding heavy-chain ISVD's, such as those described in WO 03/035694, WO 04/003019, WO 05/118642, WO 06/059106, WO 08/096158, WO 09/121804WO 10/108937 or US 2013/0129727, i.e. by suitably introducing threonine (T) at position 89, and optionally one or more of the other amino acid residues/substitutions described herein) and optionally (and usually preferably as outlined herein) adding a C-terminal extension (as further described herein).

Some preferred but non-limiting examples of such serum albumin binding Nanobodies of the invention are humanized variants of the amino acid sequence of SEQ ID NO: 52 of WO 2006/122787 (called "Alb-1" in WO 2006/122787), in which the amino acid at position 89 is T (and which is optionally provided with a C-terminal extension as described herein), such as the humanized variants of Alb-1 that are given in SEQ ID NO's: 57 to 64 of WO 2006/122787 (in each case, with a V89T substitution, and optionally with a C-terminal extension) or the humanized variants of Alb-1 that are given in SEQ ID NO's 3 to 11 of WO 2012/175400 (again, in each case, with a V89T substitution), of which SEQ ID NO's 3, 4 and 5 can optionally contain a C-terminal extension, and SEQ ID NO's 6 to 11 already contain a C-terminal extension (and again, such variants can contain one or more of the other specific amino acid residues/substitutions mentioned herein, such as 11L, L11V, L11K, 14A, P14A, 14P, A14P, 108L, Q108L, 110K, T110K, 110Q, T110Q, 112Q, 112K, S112Q and/or S112K; although usually the presence of one or two additional substitutions at positions 110 and/or 112 will not often not be required when position 89 is T, in which case position 110 is preferably T and position 112 is preferably S). Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from)

glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

Thus, in a further aspect, the invention relates to a Nanobody of the invention (as defined herein) that can bind (and in particular specifically bind) to serum albumin (and in particular human serum albumin) in which:

CDR1 is the amino acid sequence SFGMS (SEQ ID NO:41);

CDR2 is the amino acid sequence SISGSGSDTLY-ADSVKG (SEQ ID NO:42);

CDR3 is the amino acid sequence GGSLSR (SEQ ID NO:43);

the amino acid residue at position 89 is T;

and that optionally contains at its C-terminal end a C-terminal extension $(X)_n$ in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I) (again, such a C-terminal extension is preferably as further described herein, and again such a Nanobody can also for example also contain one or more of the other specific amino acid residues/substitutions mentioned herein, such as 11L, L11V, L11K, 14A, P14A, 14P, A14P, 108L, Q108L, 110K, T110K, 110Q, T110Q, 112Q, 112K, S112Q and/or S112K; although usually the presence of one or two additional substitutions at positions 110 and/or 112 will not often not be required when position 89 is T, in which case position 110 is preferably T and position 112 is preferably S). Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

In a particular aspect, the invention relates to a Nanobody of the invention (as defined herein) that can bind (and in particular specifically bind) to serum albumin (and in particular human serum albumin) that is a humanized variant of SEQ ID NO: 52 of WO 2006/122787 in which:

CDR1 is the amino acid sequence SFGMS (SEQ ID NO:41);

CDR2 is the amino acid sequence SISGSGSDTLY-ADSVKG (SEQ ID NO:42);

CDR3 is the amino acid sequence GGSLSR (SEQ ID NO:43);

the amino acid residue at position 89 is T;

and that optionally contains at its C-terminal end a C-terminal extension $(X)_n$ in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I) (again, such a C-terminal extension is preferably as further described herein, and again such a Nanobody can also for example also contain one or more of the other specific amino acid residues/substitutions mentioned herein, such as 11L, L11V, L11K, 14A, P14A, 14P, A14P, 108L, Q108L, 110K, T110K, 110Q, T110Q, 112Q, 112K, S112Q and/or S112K; although usually the presence of one or two additional substitutions at positions 110 and/or 112 will not often not be required when position 89 is T, in which case position 110 is preferably T and position 112 is preferably S). Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

In a particular aspect, the invention relates to a Nanobody of the invention (as defined herein) that can bind (and in particular specifically bind) to serum albumin (and in particular human serum albumin) that has at least 80%, preferably at least 85%, more preferably at least 90% such as at least 95% sequence identity with at least one of Alb-1 (SEQ ID NO: 52 of WO 2006/122787), Alb-8 (SEQ ID NO: 46 herein) and/or Alb-23 (SEQ ID NO:61 herein) (taking into account both the framework sequences and the CDR's, but not any C-terminal extension), in which the amino acid residue at position 89 is T, and that optionally contains at its C-terminal end a C-terminal extension $(X)_n$ in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I) (again, such a C-terminal extension is preferably as further described herein, and again such a Nanobody can also for example also contain one or more of the other specific amino acid residues/substitutions mentioned herein, such as 11L, L11V, L11K, 14A, P14A, 14P, A14P, 108L, Q108L, 110K, Ti 10K, 110Q, T110Q, 112Q, 112K, S112Q and/or S112K; although usually the presence of one or two additional substitutions at positions 110 and/or 112 will not often not be required when position 89 is T, in which case position 110 is preferably T and position 112 is preferably S). Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

According to one specific aspect, any such serum albumin-binding Nanobody of the invention with a T at position 89 can also have the amino acid residues that are characteristic of Alb-23 and its variants as described in WO 12/175400 (i.e. the amino acid motif GP on positions 44 and 45, the amino acid motif SKN on positions 74 to 76, and preferably a G at position 16 and optionally also an R at position 83).

As with the VH domains of the invention that contain an Q or K at position 112, the VH domains of the invention that contain a T at position 89 (optionally together with a Q or K at position 112 and/or together with a C-terminal extension) show reduced binding by pre-existing antibodies, and in particular by such pre-existing antibodies (as for example are found in samples obtained from SLE patients) that are capable of binding to VH domains and Nanobodies in the presence of a C-terminal extension.

In yet another aspect, the invention relates to an immunoglobulin heavy-chain variable domain (VH domain) in which the amino acid residue at position 89 (Kabat numbering) is leucine (L) and the amino acid residue at position 110 is either a lysine (K) residue or glutamine (Q) residue. Such immunoglobulin heavy-chain variable domains (VH domain) with an L at position 89 and a K or Q at position 110 are also included in the term "VH domains of the invention" as used herein in its broadest sense and can further be as described herein for the other VH domains of the invention (i.e. those that comprise a K or Q at position 112 or that comprise a T at position 89). Accordingly, such an immunoglobulin heavy-chain variable domain (VH domain) can have a C-terminal extension as further described herein (including the indicated preferences for such a C-terminal extension); can be an ISVD and in particular a Nanobody as further described herein.

Again, if such a VH domain of the invention has an exposed C-terminal region (for example, because it forms the C-terminal end of the protein, polypeptide or other construct in which it is present), it preferably contains a C-terminal extension (reference is made to the data shown in Table C below).

Also, Nanobodies of the invention in which position 89 is L and a K or Q at position 110 (i.e. with or without a C-terminal extension) preferably contain an amino acid at position 11 that is chosen from L (the most often occurring amino acid residue in VHH's), E, K, M, S, V, W or Y; more preferably from L, E, K, V or Y, and even more preferably from L, K or V (with V being most preferred). For example, they can contain an L11K or L11V substitution, as well as for example a P14A or A14P substitution and/or a Q108L substitution (they can also suitably contain an S112K and/or S112Q mutation, although usually the presence of an additional substitution at positions 112 will not often not be required when position 89 is L and position 110 is K or Q, in which case position 112 is preferably S). Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

Also, in one aspect, in such VH domains of the invention in which 89 is L and 110 is K or Q, the amino acid residue at position 112 is serine (S). More in particular, the C-terminal end of such a VH domain may be one of (and preferably is one of) VKVSS (SEQ ID NO: 95), VQVSS (SEQ ID NO: 96), VKVSS$(X)_n$ (SEQ ID NO:97) or VQVSS $(X)_n$ (SEQ ID NO: 98), in which n and X are as further described herein for the VH domains of the invention in which position 112 is Q or K (and in which any C-terminal extension is preferably as further described herein for the VH domains of the invention in which position 112 is Q or K). Also, as is the case for the VH domains of the invention in which position 112 is Q or K or position 89 is T, when such a VH domain with an L at position 89 and a K or Q at position 110 is a nanobody, position 11 is preferably a leucine (L), position 14 can in particular be alanine (A) or proline (P) and position 108 can in particular be Q or L (and in humanized nanobodies preferably L); and such a Nanobody with an L at position 89 and a K or Q at position 110 can contain one or more nanobody hallmark residues and/or can be suitably humanized. Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

Such a VH domain of the invention with an L at position 89 and a K or Q at position 110 can again also be a serum albumin Nanobody as further described herein. For example, such a serum albumin-binding Nanobody can be one of the sequences of SEQ ID NOs: 46 to 75, but with an L at position 89 and a K or Q at position 110; or another serum albumin binding Nanobody with an L at position 89 and a K or Q at position 110 that has at least 80%, preferably at least 85%, more preferably at least 90% such as at least 95% sequence identity with at least one of Alb-1 (SEQ ID NO: 52 of WO 2006/122787), Alb-8 (SEQ ID NO: 46 herein) and/or Alb-23 (SEQ ID NO:61 herein) (taking into account both the framework sequences and the CDR's, but not any C-terminal extension).

More generally, a VH domain against serum albumin according to this aspect of the invention can be one of the Nanobodies against (human) serum albumin that are described in WO 2004/041865, and in particular in WO 2006/122787 and WO 2012/175400 (all applications from applicant/assignee), in which the amino acid at position 89 is a leucine (L) and the amino acid residue at position 110 is of K or Q, and which is optionally provided with a C-terminal extension as described herein (and can also for example also contain one or more of the other specific amino acid residues/substitutions mentioned herein, such as 11L, L11V, L11K, 14A, P14A, 14P, A14P, 108L and/or Q108L; as well as S112K or S112Q, although usually the presence of an additional substitution at position 112 will not often not be required when position 89 is L and position 110 is K or Q, in which case position 112 is preferably S). Furthermore, it is envisaged that the present invention can also be applied other serum-albumin binding heavy-chain ISVD's, such as those described in WO 03/035694, WO 04/003019, WO 05/118642, WO 06/059106, WO 08/096158, WO 09/121804WO 10/108937 or US 2013/0129727, i.e. by suitably introducing leucine (L) at position 89 and either K or Q at position 110, and optionally one or more of the other amino acid residues/substitutions described herein) and optionally (and usually preferably as outlined herein) adding a C-terminal extension (as further described herein). In these VH domains against serum albumin, the amino acid at position 112 is preferably S, and said VH domains preferably have a C-terminal end that is one of SEQ ID NO's: 95 to 98. Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

Some preferred but non-limiting examples of such serum albumin binding Nanobodies of the invention are humanized variants of the amino acid sequence of SEQ ID NO: 52 of WO 2006/122787 (called "Alb-1" in WO 2006/122787), in which the amino acid at position 89 is L and the amino acid at position 110 is K or Q (and which is optionally provided with a C-terminal extension as described herein), such as the humanized variants of Alb-1 that are given in SEQ ID NO's: 57 to 64 of WO 2006/122787 (in each case, with a V89L substitution and a T110Q or T110K substitution, and optionally with a C-terminal extension) or the humanized variants of Alb-1 that are given in SEQ ID NO's 3 to 11 of WO 2012/175400 (again, in each case, with a V89L substitution and a T110Q or T110K substitution), of which SEQ ID NO's 3, 4 and 5 can optionally contain a C-terminal extension, and SEQ ID NO's 6 to 11 already contain a C-terminal extension (and again, such variants can contain one or more of the other specific amino acid residues/substitutions mentioned herein, such as 11L, L11V, L11K, 14A, P14A, 14P, A14P, 108L and/or Q108L; as well as S112K or S112Q, although usually the presence of an additional substitution at position 112 will not often not be required when position 89 is L and position 110 is K or Q, in which case position 112 is preferably S). In these VH domains against serum albumin, the amino acid at position 112 is preferably S, and said VH domains preferably have a C-terminal end that is one of SEQ ID NO's: 95 to 98. Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

Thus, in a further aspect, the invention relates to a Nanobody of the invention (as defined herein) that can bind (and in particular specifically bind) to serum albumin (and in particular human serum albumin) in which:

CDR1 is the amino acid sequence SFGMS (SEQ ID NO:41);

CDR2 is the amino acid sequence SISGSGSDTLYADSVKG (SEQ ID NO:42);

CDR3 is the amino acid sequence GGSLSR (SEQ ID NO:43);

the amino acid residue at position 89 is L;

the amino acid residue at position 110 is K or Q;

and that optionally contains at its C-terminal end a C-terminal extension $(X)_n$ in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I) (again, such a C-terminal extension is preferably as further described herein, and again such a Nanobody can also for example also contain one or more of the other specific amino acid residues/substitutions mentioned herein, such as 11L, L11V, L11K, 14A, P14A, 14P, A14P, 108L and/or Q108L; as well as S112K or S112Q, although usually the presence of an additional substitution at position 112 will not often not be required when position 89 is L and position 110 is K or Q, in which case position 112 is preferably S). In these VH domains against serum albumin, the amino acid at position 112 is preferably S, and said VH domains preferably have a C-terminal end that is one of SEQ ID NO's: 95 to 98. Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

In a particular aspect, the invention relates to a Nanobody of the invention (as defined herein) that can bind (and in particular specifically bind) to serum albumin (and in particular human serum albumin) that is a humanized variant of SEQ ID NO: 52 of WO 2006/122787 in which:

CDR1 is the amino acid sequence SFGMS (SEQ ID NO:41);

CDR2 is the amino acid sequence SISGSGSDTLYADSVKG (SEQ ID NO:42);

CDR3 is the amino acid sequence GGSLSR (SEQ ID NO:43);

the amino acid residue at position 89 is L;

the amino acid residue at position 110 is K or Q;

and that optionally contains at its C-terminal end a C-terminal extension $(X)_n$ in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I) (again, such a C-terminal extension is preferably as further described herein, and again such a Nanobody can also for example also contain one or more of the other specific amino acid residues/substitutions mentioned herein, such as 11L, L11V, L11K, 14A, P14A, 14P, A14P, 108L and/or Q108L; as well as S112K or S112Q, although usually the presence of an additional substitution at position 112 will not often not be required when position 89 is L and position 110 is K or Q, in which case position 112 is preferably S)). In these VH domains against serum albumin, the amino acid at position 112 is preferably S, and said VH domains preferably have a C-terminal end that is one of SEQ ID NO's: 95 to 98. Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

In a particular aspect, the invention relates to a Nanobody of the invention (as defined herein) that can bind (and in particular specifically bind) to serum albumin (and in particular human serum albumin) that has at least 80%, preferably at least 85%, more preferably at least 90% such as at least 95% sequence identity with at least one of Alb-1 (SEQ ID NO: 52 of WO 2006/122787), Alb-8 (SEQ ID NO: 46 herein) and/or Alb-23 (SEQ ID NO:61 herein) (taking into account both the framework sequences and the CDR's, but not any C-terminal extension), in which the amino acid residue at position 89 is L and the amino acid residue at position 110 is K or Q, and that optionally contains at its C-terminal end a C-terminal extension $(X)_n$ in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I) (again, such a C-terminal extension is preferably as further described herein, and again such a Nanobody can also for example also contain one or more of the other specific amino acid residues/substitutions mentioned herein, such as 11L, L11V, L11K, 14A, P14A, 14P, A14P, 108L and/or Q108L; as well as S112K or S112Q, although usually the presence of an additional substitution at position 112 will not often not be required when position 89 is L and position 110 is K or Q, in which case position 112 is preferably S). Such a Nanobody of the invention is again preferably a humanized variant of Alb-1 (but with a V89L and T110K or T110Q substitution), and more preferably has at least one, in particular any two, and more in particular all three of CDR1, CDR2 and/or CDR3 given in SEQ ID NO's 41 to 43, respectively. In these VH domains against serum albumin, the amino acid at position 112 is preferably S, and said VH domains preferably have a C-terminal end that is one of SEQ ID NO's: 95 to 98. Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

According to one specific aspect, any such serum albumin-binding Nanobody of the invention with an L at position 89 and a K or Q at position 110 can also have the amino acid residues that are characteristic of Alb-23 and its variants as described in WO 12/175400 (i.e. the amino acid motif GP on positions 44 and 45, the amino acid motif SKN on positions 74 to 76, and preferably a G at position 16 and optionally also an R at position 83). Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

As with the VH domains of the invention that contain an Q or K at position 112 or that have a T at position 89, the VH domains of the invention that contain an L at position 89 and a K or Q at position 110 show reduced binding by pre-existing antibodies, and in particular by such pre-existing antibodies (as for example are found in samples obtained from SLE patients) that are capable of binding to VH domains and Nanobodies in the presence of a C-terminal extension.

Some non-limiting examples of VH domains of the invention that have an L at position 89 and a K at position 110 (and in addition, a V at position 11) are given in FIG. 2 as SEQ ID NO's: 123-136. These are VH domains binding to human serum albumin and have the CDR's indicated herein for the preferred serum albumin binding VH domains of the invention.

In yet another aspect, the invention relates to an immunoglobulin heavy-chain variable domain (VH domain) in which the amino acid residue at position 89 (Kabat numbering) is leucine (L) and the amino acid residue at position 11 is valine (V). Such immunoglobulin heavy-chain variable domains (VH domain) with an L at position 89 and a V at position 11 are also included in the term "VH domains of the invention" as used herein in its broadest sense and can further be as described herein for the other VH domains of the invention described herein (i.e. those that comprise a K or Q at position 112, that comprise a T at position 89, or that comprise an L at position 89 and a K or Q at position 110; albeit that for the VH domains according to the current aspect, the amino acid residue at position 89 will be L, at amino acid residue at position 11 will be V, and the amino acid residues at positions 110 and 112, respectively, can be any amino acid residue suitable for these positions). Accordingly, such an immunoglobulin heavy-chain variable domain (VH domain) can have a C-terminal extension as further described herein (including the indicated preferences for such a C-terminal extension); can be an ISVD and in particular a Nanobody as further described herein.

Again, if such a VH domain of the invention has an exposed C-terminal region (for example, because it forms the C-terminal end of the protein, polypeptide or other construct in which it is present), it preferably contains a C-terminal extension (reference is made to the data shown in Table C below).

Also, Nanobodies of the invention in which position 89 is L and position 11 is V (i.e. with or without a C-terminal extension): (i) preferably contain an amino acid at position 110 that is chosen from T, I, A, K or Q (and preferably from T, K or Q, and that in particular can be T); (ii) preferably contain an amino acid at position 112 that is chosen from S, F, K or Q (and more preferably S, K or Q, and that in particular can be S); and (iii) can for example also contain a P14A or A14P substitution and/or a Q108L substitution. According to one specific embodiment, in the VH domains according to this aspect of the invention, the amino acid residue at position 110 is T and the amino acid residue at position 112 is S, and more preferably the C-terminal end is either VTVSS (SEQ ID NO: 77) or VTVSS(X)n (SEQ ID NO: 78), in which X and n are as defined herein for the C-terminal extension of the other VH domains of the invention. Also, in the VH domains according to this aspect of the invention: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

Thus, for example, in such VH domains of the invention in which 89 is L and 11 is V, the C-terminal end of such a VH domain may be one of (and preferably is one of) VTVSS (SEQ ID NO:77), VTVSS(X)n (SEQ ID NO:78), VTVKS (SEQ ID NO:1), VTVKS(X)n (SEQ ID NO:21), VTVQS (SEQ ID NO:2), VTVQS(X)n (SEQ ID NO:22), VKVSS (SEQ ID NO: 95), VKVSS(X)n (SEQ ID NO:97), VQVSS (SEQ ID NO: 96), VQVSS(X)n (SEQ ID NO: 98), VZVZS (SEQ ID NO: 107, in which each amino acid residue Z is independently K or Q) or VZVZSX(n) (SEQ ID NO:108, in which each amino acid residue Z is independently K or Q) (and is in particular one of VTVSS, VKVSS (SEQ ID NO: 95), VQVSS (SEQ ID NO: 96), VKVSS$(X)_n$ (SEQ ID NO:97) or VQVSS$(X)_n$(SEQ ID NO: 98), and may more in particular be either VTVSS (SEQ ID NO:77) or VTVSS(X)n (SEQ ID NO:78)), in which n and X are as further described herein for the VH domains of the invention in which position 112 is Q or K (and in which any C-terminal extension is preferably as further described herein for the VH domains of the invention in which position 112 is Q or K). Also, as is the case for the VH domains of the invention in which position 112 is Q or K or position 89 is T, when such a VH domain with an L at position 89 and a V at position 11 is a nanobody, position 14 can in particular be alanine (A) or proline (P) and position 108 can be Q or L (and in humanized nanobodies preferably L); and such a Nanobody with an L at position 89 and a V at position 11 can contain one or more nanobody hallmark residues and/or can be suitably humanized. Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

Such a VH domain of the invention with an L at position 89 and a V at position 11 can again also be a serum albumin Nanobody as further described herein. For example, such a serum albumin-binding Nanobody can be one of the sequences of SEQ ID NOs: 46 to 75, but with an L at position 89 and a V at position 11; or another serum albumin binding Nanobody with an L at position 89 and a V at position 11 that has at least 80%, preferably at least 85%, more preferably at least 90% such as at least 95% sequence identity with at least one of Alb-1 (SEQ ID NO: 52 of WO 2006/122787), Alb-8 (SEQ ID NO: 46 herein) and/or Alb-23 (SEQ ID NO:61 herein) (taking into account both the framework sequences and the CDR's, but not any C-terminal extension).

More generally, a VH domain against serum albumin according to this aspect of the invention can be one of the Nanobodies against (human) serum albumin that are described in WO 2004/041865, and in particular in WO 2006/122787 and WO 2012/175400 (all applications from applicant/assignee), in which the amino acid at position 89 is a leucine (L) and the amino acid residue at position 11 is V, and which is optionally provided with a C-terminal extension as described herein (and can also for example also suitably contain one or more of the other specific amino acid residues/substitutions mentioned herein, such as 14A, P14A, 14P, A14P, 108L, Q108L, V110K, V110Q, S112K and/or S112Q). Furthermore, it is envisaged that the present invention can also be applied other serum-albumin binding heavy-chain ISVD's, such as those described in WO 03/035694, WO 04/003019, WO 05/118642, WO 06/059106, WO 08/096158, WO 09/121804WO 10/108937 or US 2013/0129727, i.e. by suitably introducing leucine (L) at position 89 and valine at position 11, and optionally one or more of the other amino acid residues/substitutions described herein) and optionally (and usually preferably as outlined herein) adding a C-terminal extension (as further described herein). In these VH domains against serum albumin, the amino acid at position 112 is preferably S, and said VH domains preferably have a C-terminal end that is one of SEQ ID NO's: 95 to 98. Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

Some preferred but non-limiting examples of such serum albumin binding Nanobodies of the invention are humanized variants of the amino acid sequence of SEQ ID NO: 52 of WO 2006/122787 (called "Alb-1" in WO 2006/122787), in which the amino acid at position 89 is L and the amino acid at position 11 is V (and which is optionally provided with a C-terminal extension as described herein), such as the humanized variants of Alb-1 that are given in SEQ ID NO's: 57 to 64 of WO 2006/122787 (in each case, with a V89L substitution and a L11V substitution, and optionally with a C-terminal extension) or the humanized variants of Alb-1 that are given in SEQ ID NO's 3 to 11 of WO 2012/175400 (again, in each case, with a V89L substitution and a L11V), of which SEQ ID NO's 3, 4 and 5 can optionally contain a C-terminal extension, and SEQ ID NO's 6 to 11 already contain a C-terminal extension (and again, such variants can suitably contain one or more of the other specific amino acid residues/substitutions mentioned herein, such as 14A, P14A, 14P, A14P, 108L, Q108L, T110K, T110Q, S112K and/or S112Q). In these VH domains against serum albumin with an L at position 89 and a V at position 11, the amino acid at position 110 is preferably T and the amino acid residue at position 112 is preferably S, and said VH domains preferably have a C-terminal end that is one of SEQ ID NO's: 95 to 98. Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

Thus, in a further aspect, the invention relates to a Nanobody of the invention (as defined herein) that can bind (and in particular specifically bind) to serum albumin (and in particular human serum albumin) in which:

- CDR1 is the amino acid sequence SFGMS (SEQ ID NO:41);
- CDR2 is the amino acid sequence SISGSGSDTLYADSVKG (SEQ ID NO:42);
- CDR3 is the amino acid sequence GGSLSR (SEQ ID NO:43);
- the amino acid residue at position 89 is L;
- the amino acid residue at position 11 is V;

in which preferably

- the amino acid residue at position 110 is one of K, Q or T, and more preferably T;
- the amino acid residue at position 112 is one of K, Q or S, and more preferably S;

and that optionally contains at its C-terminal end a C-terminal extension $(X)_n$ in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I) (again, such a C-terminal extension is preferably as further described herein, and again such a Nanobody can also for example also suitably contain one or more of the other specific amino acid residues/substitutions mentioned herein, such as 14A, P14A, 14P, A14P, 108L, Q108L). Again, in these VH domains against serum albumin with an L at position 89 and a V at position 11, the amino acid at position 110 is preferably T and the amino acid at position 112 is preferably S, and said VH domains preferably have a C-terminal end that is one of SEQ ID NO's: 95 to 98. Also: (i) position 41 may for example be one of the amino acid residues (i.e. human VH3 residues and/or Camelid VHH residues) mentioned in Table A-6 of WO 08/020079 for position 41 and may in particular be (or be chosen from)

proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

In a particular aspect, the invention relates to a Nanobody of the invention (as defined herein) that can bind (and in particular specifically bind) to serum albumin (and in particular human serum albumin) that is a humanized variant of SEQ ID NO: 52 of WO 2006/122787 in which:

CDR1 is the amino acid sequence SFGMS (SEQ ID NO:41);

CDR2 is the amino acid sequence SISGSGSDTLYADSVKG (SEQ ID NO:42);

CDR3 is the amino acid sequence GGSLSR (SEQ ID NO:43);

the amino acid residue at position 89 is L;

the amino acid residue at position 11 is V;

and preferably:

the amino acid residue at position 110 is one of K, Q or T, and more preferably T;

the amino acid residue at position 112 is one of K, Q or S, and more preferably S;

and that optionally contains at its C-terminal end a C-terminal extension $(X)_n$ in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I) (again, such a C-terminal extension is preferably as further described herein, and again such a Nanobody can also for example also contain one or more of the other specific amino acid residues/substitutions mentioned herein, such as 11L, L11V, L11K, 14A, P14A, 14P, A14P, 108L and/or Q108L). In these VH domains against serum albumin with an L at position 89 and a V at position 11, the amino acid residue at position 110 is preferably T and the amino acid residue at position 112 is preferably S, and said VH domains preferably have a C-terminal end that is one of SEQ ID NO's: 95 to 98. Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

In a particular aspect, the invention relates to a Nanobody of the invention (as defined herein) that can bind (and in particular specifically bind) to serum albumin (and in particular human serum albumin) that has at least 80%, preferably at least 85%, more preferably at least 90% such as at least 95% sequence identity with at least one of Alb-1 (SEQ ID NO: 52 of WO 2006/122787), Alb-8 (SEQ ID NO: 46 herein) and/or Alb-23 (SEQ ID NO:61 herein) (taking into account both the framework sequences and the CDR's, but not any C-terminal extension), in which the amino acid residue at position 89 is L and the amino acid residue at position 11 is V, and that optionally contains at its C-terminal end a C-terminal extension $(X)_n$ in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I) (again, such a C-terminal extension is preferably as further described herein, and again such a Nanobody can also for example also suitably contain one or more of the other specific amino acid residues/substitutions mentioned herein, such as 14A, P14A, 14P, A14P, 108L, Q108L, T110K, T110Q, S112K and/or S112Q). Such a Nanobody of the invention is again preferably a humanized variant of Alb-1 (but with a V89L and L11V substitution), and more preferably has at least one, in particular any two, and more in particular all three of CDR1, CDR2 and/or CDR3 given in SEQ ID NO's 41 to 43, respectively. In these VH domains against serum albumin, the amino acid at position 112 is preferably S, and said VH domains preferably have a C-terminal end that is one of SEQ ID NO's: 95 to 98. Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

According to one specific aspect, any such serum albumin-binding Nanobody of the invention with an L at position 89 and a V at position 11 can also have the amino acid residues that are characteristic of Alb-23 and its variants as described in WO 12/175400 (i.e. the amino acid motif GP on positions 44 and 45, the amino acid motif SKN on positions 74 to 76, and preferably a G at position 16 and optionally also an R at position 83). Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

As with the VH domains of the invention that contain an Q or K at position 112 or that have a T at position 89, the VH domains of the invention that contain an L at position 89 and a V at position 11 show reduced binding by pre-existing antibodies, and in particular by such pre-existing antibodies (as for example are found in samples obtained from SLE patients) that are capable of binding to VH domains and Nanobodies in the presence of a C-terminal extension. One further thing to note with the VH domains of the invention is which position 89 is L and position 11 is V is that these substitutions are known to occur with some frequency in human VH domains (see Table A-5 of WO 08/020079 for position 11 and Table A-7 of WO 08/020079 of position 89).

Some non-limiting examples of VH domains of the invention that have a V at position 11 and a T at position 89 are given in FIG. 2 as SEQ ID NO's: 109-136. Of these VH domains, the sequences given as SEQ ID NO's: 123-136 contain, in addition to the L11V and V89L mutations, also a T110K mutation. These are VH domains binding to human serum albumin and have the CDR's indicated herein for the preferred serum albumin binding VH domains of the invention.

In a further aspect, the invention relates to a VH domain (and in particular a VH domain that is an ISVD, and more in particular a VH domain that is a nanobody), in which:

- the amino acid residue at position 11 is V; and
- the amino acid residue at position 14 is one of A or P; and
- the amino acid residue at position 41 is one of A or P; and
- the amino acid residue at position 89 is L; and
- the amino acid residue at position 108 is one of Q or L; and
- the amino acid residue at position 110 is one of T, K or Q; and
- the amino acid residue at position 112 is one of S, K or Q;

and in which said VH domain optionally contains a C-terminal extension $(X)_n$, in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I) (which C-terminal extension is preferably as further described herein). Also: (i) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (ii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A). Preferably, in the VH domains according to this paragraph, the amino acid residue at position 110 is T and the amino acid residue at position 112 is S. Again, as with the other VH domains of the invention, such a VH domain may be directed against any suitable target (and in particular a therapeutically relevant target). According to one specific aspect, such a VH domain is directed to serum albumin.

In a further aspect, the invention relates to a VH domain (and in particular a VH domain that is an ISVD, and more in particular a VH domain that is a nanobody), in which:

- the amino acid residue at position 11 is one of L, V or K; and
- the amino acid residue at position 14 is one of A or P; and
- the amino acid residue at position 41 is one of A or P; and
- the amino acid residue at position 89 is one of T, V or L; and
- the amino acid residue at position 108 is one of Q or L; and
- the amino acid residue at position 110 is one of T, K or Q; and
- the amino acid residue at position 112 is one of S, K or Q;

in which either (i) the amino acid residue at position 112 is one of K or Q; and/or (ii) the amino acid residue at position 89 is T; and/or (iii) the amino acid residue at position 89 is L and the amino acid residue at position 110 is one of K or Q; and (iv) in each of cases (i) to (iii), the amino acid at position 11 is preferably V; and in which said VH domain optionally contains a C-terminal extension $(X)_n$, in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I) (which C-terminal extension is preferably as further described herein). Also: (i) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (ii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A). Another aspect of the invention relates to a VH domain (and in particular a VH domain that is an ISVD, and more in particular a VH domain that is a nanobody) which is as described in this paragraph, in which the amino acid residue at position 11 is V and the amino acid residue at position 110 is either K or Q (and in which the amino acid residues at positions 14, 41, 89, 108 and 112 can be as listed in the above bullet points, the amino acid residues at positions 42 and 87 can for example be as described in this paragraph, and the VH domain can optionally contain a C-terminal extension $(X)_n$ as described in this paragraph).

In a further aspect, the invention relates to a VH domain (and in particular a VH domain that is an ISVD, and more in particular a VH domain that is a nanobody), in which:

- the amino acid residue at position 11 is one of L, V or K; and
- the amino acid residue at position 14 is one of A or P; and
- the amino acid residue at position 41 is one of A or P; and
- the amino acid residue at position 89 is one of T, V or L; and
- the amino acid residue at position 108 is one of Q or L; and
- the amino acid residue at position 110 is one of T, K or Q; and
- the amino acid residue at position 112 is one of S, K or Q;

in which either (i) the amino acid residue at position 112 is one of K or Q, the amino at position 89 is one of T, V or L (and is preferably V), and the amino acid residue at position 110 is one of T, K or Q (and is preferably T); and/or (ii) the amino acid residue at position 89 is T, and the amino acid residue at position 112 is one of S, K or Q (and is preferably S), and the amino acid residue at position 110 is one of T, K or Q (and is preferably T); and/or (iii) the amino acid residue at position 89 is L and the amino acid residue at position 110 is one of K or Q, and the amino acid residue at position 112 is one of S, K or Q (and is preferably S); and (iv) in each of cases (i) to (iii), the amino acid at position 11 is preferably V; and in which said VH domain optionally contains a C-terminal extension $(X)_n$, in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I) (which C-terminal extension is preferably as further described herein). Also: (i) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (ii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A). Another aspect of the invention relates to a VH domain (and in particular a VH domain that is an ISVD, and more in particular a VH domain that is a nanobody) which is as described in this paragraph, in which the amino acid residue at position 11 is V and the amino acid residue at position 110 is either K or Q (and in which the amino acid residues at positions 14, 41, 89, 108 and 112 can be as listed in the above bullet points, the amino acid residues at positions 42 and 87 can for example be as described in this paragraph, and the VH domain can optionally contain a C-terminal extension $(X)_n$ as described in this paragraph).

In a further aspect, the invention relates to a VH domain (and in particular a VH domain that is an ISVD, and more in particular a VH domain that is a nanobody), in which:

- the amino acid residue at position 11 is one of L, V or K; and
- the amino acid residue at position 14 is one of A or P; and
- the amino acid residue at position 41 is one of A or P; and
- the amino acid residue at position 89 is one of T, V or L; and
- the amino acid residue at position 108 is one of Q or L; and
- the amino acid residue at position 110 is one of T, K or Q; and
- the amino acid residue at position 112 is one of S, K or Q;

in which either (i) the amino acid residue at position 112 is one of K or Q; or (ii) the amino acid residue at position 89 is T; or (iii) the amino acid residue at position 89 is L and the amino acid residue at position 110 is one of K or Q; and (iv) in each of cases (i) to (iii), the amino acid at position 11 is preferably V; and in which said VH domain optionally contains a C-terminal extension $(X)_n$, in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I) (which C-terminal extension is preferably as further described herein). Also: (i) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (ii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A). Another aspect of the invention relates to a VH domain (and in particular a VH domain that is an ISVD, and more in particular a VH domain that is a nanobody) which is as described in this paragraph, in which the amino acid residue at position 11 is V and the amino acid residue at position 110 is either K or Q (and in which the amino acid residues at positions 14, 41, 89, 108 and 112 can be as listed in the above bullet points, the amino acid residues at positions 42 and 87 can for example be as described in this paragraph, and the VH domain can optionally contain a C-terminal extension $(X)_n$ as described in this paragraph).

In a further aspect, the invention relates to a VH domain (and in particular a VH domain that is an ISVD, and more in particular a VH domain that is a nanobody), in which:

- the amino acid residue at position 11 is one of L, V or K; and
- the amino acid residue at position 14 is one of A or P; and
- the amino acid residue at position 41 is one of A or P; and
- the amino acid residue at position 89 is one of T, V or L; and
- the amino acid residue at position 108 is one of Q or L; and
- the amino acid residue at position 110 is one of T, K or Q; and
- the amino acid residue at position 112 is one of S, K or Q;

in which either (i) the amino acid residue at position 112 is one of K or Q, the amino at position 89 is one of T, V or L (and is preferably V), and the amino acid residue at position 110 is one of T, K or Q (and is preferably T); or (ii) the amino acid residue at position 89 is T, and the amino acid residue at position 112 is one of S, K or Q (and is preferably S), and the amino acid residue at position 110 is one of T, K or Q (and is preferably T); or (iii) the amino acid residue at position 89 is L, and the amino acid residue at position 110 is one of K or Q, and the amino acid residue at position 112 is one of S, K or Q (and is preferably S); and (iv) in each of cases (i) to (iii), the amino acid at position 11 is preferably V;

and in which said VH domain optionally contains a C-terminal extension $(X)_n$, in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I) (which C-terminal extension is preferably as further described herein). Also: (i) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (ii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A). Another aspect of the invention relates to a VH domain (and in particular a VH domain that is an ISVD, and more in particular a VH domain that is a nanobody) which is as described in this paragraph, in which the amino acid residue at position 11 is V and the amino acid residue at position 110 is either K or Q (and in which the amino acid residues at positions 14, 41, 89, 108 and 112 can be as listed in the above bullet points, the amino acid residues at positions 42 and 87 can for example be as described in this paragraph, and the VH domain can optionally contain a C-terminal extension $(X)_n$ as described in this paragraph).

In a further aspect, the invention relates to a VH domain (and in particular a VH domain that is an ISVD, and more in particular a VH domain that is a nanobody), in which:

- the amino acid residue at position 11 is one of L, V or K; and
- the amino acid residue at position 14 is one of A or P; and
- the amino acid residue at position 41 is one of A or P; and
- the amino acid residue at position 89 is one of T, V or L; and
- the amino acid residue at position 108 is one of Q or L; and
- the amino acid residue at position 110 is one of T, K or Q; and
- the amino acid residue at position 112 is one of S, K or Q;

in which either (i) the amino acid residue at position 112 is one of K or Q, the amino at position 89 is V, and the amino acid residue at position 110 is T; or (ii) the amino acid residue at position 89 is T, the amino acid residue at position 112 is S, and the amino acid residue at position 110 is T; or (iii) the amino acid residue at position 89 is L and the amino acid residue at position 110 is one of K or Q, and the amino acid residue at position 112 is S (and is preferably S); and (iv) in each of cases (i) to (iii), the amino acid at position 11 is preferably V; and in which said VH domain optionally contains a C-terminal extension $(X)_n$, in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I) (which C-terminal extension is preferably as further described herein). Also: (i) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (ii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A). Another aspect of the invention relates to a VH domain (and in particular a VH domain that is an ISVD, and more in particular a VH domain that is a nanobody) which is as described in this paragraph, in which the amino acid residue at position 11 is V and the amino acid residue at position 110 is either K or Q (and in which the amino acid residues at positions 14, 41, 89, 108 and 112 can be as listed in the above bullet points, the amino acid residues at positions 42 and 87 can for example be as described in this paragraph, and the VH domain can optionally contain a C-terminal extension $(X)_n$ as described in this paragraph).

In a further aspect, the invention relates to a VH domain (and in particular a VH domain that is an ISVD, and more in particular a VH domain that is a nanobody), in which:

- the amino acid residue at position 11 is one of L, V or K; and
- the amino acid residue at position 14 is one of A or P; and
- the amino acid residue at position 41 is one of A or P; and
- the amino acid residue at position 89 is one of T, V or L; and
- the amino acid residue at position 108 is one of Q or L; and
- the amino acid residue at position 110 is one of T, K or Q; and
- the amino acid residue at position 112 is one of S, K or Q;

in which either (i) the amino acid residue at position 112 is one of K or Q; and/or (ii) the amino acid residue at position 89 is T; and/or (iii) the amino acid residue at position 89 is L and the amino acid residue at position 110 is one of K or Q; and (iv) in each of cases (i) to (iii), the amino acid at position 11 is preferably V; and in which said VH domain contains a C-terminal extension $(X)_n$, in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I) (which C-terminal extension is preferably as further described herein). Also: (i) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (ii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A). Another aspect of the invention relates to a VH domain (and in particular a VH domain that is an ISVD, and more in particular a VH domain that is a nanobody) which is as described in this paragraph, in which the amino acid residue at position 11 is V and the amino acid residue at position 110 is either K or Q (and in which the amino acid residues at positions 14, 41, 89, 108 and 112 can be as listed in the above bullet points, the amino acid residues at positions 42 and 87 can for example be as described in this paragraph, and the VH domain can optionally contain a C-terminal extension $(X)_n$ as described in this paragraph).

In a further aspect, the invention relates to a VH domain (and in particular a VH domain that is an ISVD, and more in particular a VH domain that is a nanobody), in which:

- the amino acid residue at position 11 is one of L, V or K; and
- the amino acid residue at position 14 is one of A or P; and
- the amino acid residue at position 41 is one of A or P; and
- the amino acid residue at position 89 is one of T, V or L; and
- the amino acid residue at position 108 is one of Q or L; and
- the amino acid residue at position 110 is one of T, K or Q; and
- the amino acid residue at position 112 is one of S, K or Q;

in which either (i) the amino acid residue at position 112 is one of K or Q, the amino at position 89 is one of T, V or L (and is preferably V), and the amino acid residue at position 110 is one of T, K or Q (and is preferably T); and/or (ii) the amino acid residue at position 89 is T, and the amino acid residue at position 112 is one of S, K or Q (and is preferably S), and the amino acid residue at position 110 is one of T, K or Q (and is preferably T); and/or (iii) the amino acid residue at position 89 is L and the amino acid residue at position 110 is one of K or Q, and the amino acid residue at position 112 is one of S, K or Q (and is preferably S); and (iv) in each of cases (i) to (iii), the amino acid at position 11 is preferably V; and in which said VH domain contains a C-terminal extension $(X)_n$, in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I) (which C-terminal extension is preferably as further described herein). Also: (i) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (ii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A). Another aspect of the invention relates to a VH domain (and in particular a VH domain that is an ISVD, and more in particular a VH domain that is a nanobody) which is as described in this paragraph, in which the amino acid residue at position 11 is V and the amino acid residue at position 110 is either K or Q (and in which the amino acid residues at positions 14, 41, 89, 108 and 112 can be as listed in the above bullet points, the amino acid residues at positions 42 and 87 can for example be as described in this paragraph, and the VH domain can optionally contain a C-terminal extension $(X)_n$ as described in this paragraph).

In a further aspect, the invention relates to a VH domain (and in particular a VH domain that is an ISVD, and more in particular a VH domain that is a nanobody), in which:

- the amino acid residue at position 11 is one of L, V or K; and
- the amino acid residue at position 14 is one of A or P; and
- the amino acid residue at position 41 is one of A or P; and
- the amino acid residue at position 89 is one of T, V or L; and
- the amino acid residue at position 108 is one of Q or L; and
- the amino acid residue at position 110 is one of T, K or Q; and
- the amino acid residue at position 112 is one of S, K or Q;

in which either (i) the amino acid residue at position 112 is one of K or Q; or (ii) the amino acid residue at position 89 is T; or (iii) the amino acid residue at position 89 is L and the amino acid residue at position 110 is one of K or Q; and (iv) in each of cases (i) to (iii), the amino acid at position 11 is preferably V; and in which said VH domain contains a C-terminal extension $(X)_n$, in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I) (which C-terminal extension is preferably as further described herein). Also: (i) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (ii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A). Another aspect of the invention relates to a VH domain (and in particular a VH domain that is an ISVD, and more in particular a VH domain that is a nanobody) which is as described in this paragraph, in which the amino acid residue at position 11 is V and the amino acid residue at position 110 is either K or Q (and in which the amino acid residues at positions 14, 41, 89, 108 and 112 can be as listed in the above bullet points, the amino acid residues at positions 42 and 87 can for example be as described in this paragraph, and the VH domain can optionally contain a C-terminal extension $(X)_n$ as described in this paragraph).

In a further aspect, the invention relates to a VH domain (and in particular a VH domain that is an ISVD, and more in particular a VH domain that is a nanobody), in which:

- the amino acid residue at position 11 is one of L, V or K; and
- the amino acid residue at position 14 is one of A or P; and
- the amino acid residue at position 41 is one of A or P; and
- the amino acid residue at position 89 is one of T, V or L; and
- the amino acid residue at position 108 is one of Q or L; and
- the amino acid residue at position 110 is one of T, K or Q; and
- the amino acid residue at position 112 is one of S, K or Q;

in which either (i) the amino acid residue at position 112 is one of K or Q, the amino at position 89 is one of T, V or L (and is preferably V), and the amino acid residue at position 110 is one of T, K or Q (and is preferably T); or (ii) the amino acid residue at position 89 is T, and the amino acid residue at position 112 is one of S, K or Q (and is preferably S), and the amino acid residue at position 110 is one of T, K or Q (and is preferably T); or (iii) the amino acid residue at position 89 is L, and the amino acid residue at position 110 is one of K or Q, and the amino acid residue at position 112 is one of S, K or Q (and is preferably S); and (iv) in each of cases (i) to (iii), the amino acid at position 11 is preferably V; and in which said VH domain contains a C-terminal extension $(X)_n$, in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I) (which C-terminal extension is preferably as further described herein). Also: (i) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (ii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A). Another aspect of the invention relates to a VH domain (and in particular a VH domain that is an ISVD, and more in particular a VH domain that is a nanobody) which is as described in this paragraph, in which the amino acid residue at position 11 is V and the amino acid residue at position 110 is either K or Q (and in which the amino acid residues at positions 14, 41, 89, 108 and 112 can be as listed in the above bullet points, the amino acid residues at positions 42 and 87 can for example be as described in this paragraph, and the VH domain can optionally contain a C-terminal extension $(X)_n$ as described in this paragraph).

In a further aspect, the invention relates to a VH domain (and in particular a VH domain that is an ISVD, and more in particular a VH domain that is a nanobody), in which:

the amino acid residue at position 11 is one of L, V or K; and the amino acid residue at position 14 is one of A or P; and the amino acid residue at position 41 is one of A or P; and the amino acid residue at position 89 is one of T, V or L; and the amino acid residue at position 108 is one of Q or L; and the amino acid residue at position 110 is one of T, K or Q; and the amino acid residue at position 112 is one of S, K or Q;

in which either (i) the amino acid residue at position 112 is one of K or Q, the amino at position 89 is V, and the amino acid residue at position 110 is T; or (ii) the amino acid residue at position 89 is T, the amino acid residue at position 112 is S, and the amino acid residue at position 110 is T; or (iii) the amino acid residue at position 89 is L and the amino acid residue at position 110 is one of K or Q, and the amino acid residue at position 112 is S (and is preferably S); and (iv) in each of cases (i) to (iii), the amino acid at position 11 is preferably V; and in which said VH domain contains a C-terminal extension $(X)_n$, in which n is 1 to 10, preferably 1 to 5, such as 1, 2, 3, 4 or 5 (and preferably 1 or 2, such as 1); and each X is an (preferably naturally occurring) amino acid residue that is independently chosen, and preferably independently chosen from the group consisting of alanine (A), glycine (G), valine (V), leucine (L) or isoleucine (I) (which C-terminal extension is preferably as further described herein). Also: (i) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (ii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A). Another aspect of the invention relates to a VH domain (and in particular a VH domain that is an ISVD, and more in particular a VH domain that is a nanobody) which is as described in this paragraph, in which the amino acid residue at position 11 is V and the amino acid residue at position 110 is either K or Q (and in which the amino acid residues at positions 14, 41, 89, 108 and 112 can be as listed in the above bullet points, the amino acid residues at positions 42 and 87 can for example be as described in this paragraph, and the VH domain can optionally contain a C-terminal extension $(X)_n$ as described in this paragraph).

Again, in the VH domains of the invention as defined herein, the amino acid residues at positions that are not explicitly defined herein can be any amino acid residue that is suitable at such a position for VH domains, and in particular for ISVD's and more in particular for nanobodies (including humanized VHH domains). Reference is again made to the prior art cited herein, such as for example Tables A-3 and A-5 to A-8 of WO 08/020079. Preferably, in each case, the amino acid residue at position 11 is L or V, and more preferably V. Also: (i) position 41 may for example be one of the amino acid residues (i.e. human VH3 residues and/or Camelid VHH residues) mentioned in Table A-6 of WO 08/020079 for position 41 and may in particular be (or be chosen from) proline (P), serine (S), threonine (T), alanine (A) or leucine (L), which are some of the amino acid residues that most frequently occur at this position in either humans or llamas, and may more in particular be either proline (P) or alanine (A); and/or (ii) position 42 may for example be one of the amino acid residues (i.e. human VH3 residues and/or Camelid VHH residues) mentioned in Table A-6 of WO 08/020079 for position 42 and may in particular be (or be chosen from) glycine (G) or glutamic acid (E); and/or (iii) position 87 may for example be one of the amino acid residues (i.e. human VH3 residues and/or Camelid VHH residues) mentioned in Table A-7 of WO 08/020079 for position 87 and may in particular be (or be chosen from) threonine (T) or alanine (A).

Also, said VH domain of the invention can be directed against any suitable target, and in particular a therapeutic target. In one aspect, they are directed against a human serum protein such as human serum albumin.

The invention also relates to proteins, polypeptides, constructs, compounds or other chemical entities that comprise at least one VH domain of the invention (also collectively referred to herein as "compounds of the invention").

As further described herein, according to one specific aspect, in a compound of the invention, the VH domain of the invention is present at/forms the C-terminal end of the same. In such a case, the VH domain of the invention that forms/is present at the C-terminal end of the compound of the invention preferably has a C-terminal extension as described herein.

As also further described herein, the compounds of the invention can be a ScFv, diabody or another protein, polypeptide or construct in which the one or more VH domains of the invention are associated with one or more VL domains to form one or more functional antigen-binding sites.

However, according to a preferred aspect of the invention, the VH domains of the invention are ISVD's and the compounds of the invention are proteins, polypeptides, constructs, compounds or other chemical entities that comprise or essentially consist of at least one ISVD of the invention and optionally one or more further amino acid sequences, moieties, binding domains or binding units (suitably linked to each other, optionally via one or more linkers). In particular, such compounds of the invention can comprise or essentially consist of one or more ISVD's, at least one of which is an ISVD of the invention. Such a compound of the invention may in particular have an ISVD of the invention at its C-terminal end, in which case the ISVD of the invention also preferably has a C-terminal extensions as described herein. Also, if such a compound of the invention contains two or more ISVDs, two or more or essentially all of the ISVD's present may be ISVD's of the invention (i.e. each having at least one of the following amino acid residues/substitutions: 112K, 112Q, S112K, S112Q, 89T and/or V89T, or the combination of V89L with T110K or T110Q; and optionally one or more of the further substitutions mentioned herein for ISVD's of the invention, such as L11V). Also, in such a compound of the invention, the ISVD of the invention is preferably a Nanobody of the invention, and all or essentially all of the ISVD's present in the compound of the invention may be (and preferably are) Nanobodies (and in particular Nanobodies of the invention, i.e. each having at least one of the following amino acid residues/substitutions: 112K, 112Q, S112K, S112Q, 89T and/or V89T, or the combination of V89L with T110K or T110Q; and optionally one or more of the further substitutions mentioned herein for Nanobodies of the invention, such as L11V). Examples of such compounds of the invention will be clear to the skilled person based on the further disclosure herein.

Some non-limiting examples of proteins, polypeptides, constructs, compounds or other chemical entities that comprise one or more ISVD's (including at least one ISVD of the invention) are multivalent, multispecific (such as bispecific) or multiparatopic (such as biparatopic) constructs that contain two or more ISVD's linked directly or via one or more suitable linkers. Again, the ISVD's are preferably Nanobodies. For some non-limiting examples of such constructs and a general teaching on how such constructs can be made (in particular based on Nanobodies) reference is for example made to Conrath et al., JBC 276, 10(9), 7346 (2001) as well as to the review article by Muyldermans. Reviews in Mol. Biotechnol., 74: 27 (2001).

For example, such a compound of the invention containing two or more ISVD's (at least one of which is an ISVD of the invention) may be a bivalent, trivalent, tetravalent or pentavalent construct, and/or may be a monospecific, bispecific, trispecific construct, and/or may be a biparatopic or triparatopic construct. Reference is again made to the prior art on IVSD-based and Nanobody-based biologicals cited herein. Also, such a compound of the invention may have been provided with an increased half-life by functionalization and/or by including in the construct a moiety or binding unit that increases the half-life of the construct. Examples of such functionalization, moieties or binding units will be clear to the skilled person and may for example be as described herein, and for example may include pegylation, fusion to serum albumin, or fusion to a peptide or binding unit that can bind to a serum protein such as serum albumin. Such a serum-albumin binding peptide or binding domain may be any suitable serum-albumin binding peptide or binding domain capable of increasing the half-life of the construct (compared to the same construct without the serum-albumin binding peptide or binding domain), and may in particular be serum albumin binding peptides as described in WO 2008/068280 by applicant (and in particular WO 2009/127691 and the non-prepublished U.S. application 61/301,819, both by applicant), or a serum-albumin binding ISV (such as a serum-albumin binding Nanobody; for example Alb-1 or a humanized version of Alb-1 such as Alb-8, for which reference is for example made to WO 06/122787), or an ISVD of the invention that is directed against a (human) serum protein such as (human) serum albumin (as further described herein). Generally, any compound of the invention with increased half-life will preferably have a half-life (as defined herein) in human subjects of at least 1 day, preferably at least 3 days, more preferably at least 7 days, such as at least 10 days.

When the compound of the invention comprises at least one (and preferably one) ISVD of the invention (and in particular Nanobody of the invention) that is directed against a (human) serum protein and in particular against (human) serum albumin, the compound of the invention will usually further contain one or more other therapeutically active amino acid sequences, moieties, binding domains or binding units (i.e. directed against a therapeutically relevant target, pathway or mechanism), and the ISVD of the invention will function to extend the half-life of the same (and of the entire compound). Again, said one or more further therapeutically active moieties are preferably ISVD's (and more preferably Nanobodies), and may also be IVSD's of the invention (and more preferably Nanobodies of the invention). In such compounds of the invention, the ISVD of the invention that is directed against human serum albumin may again be present at/forms the C-terminal end of the compound, and in that case may (and preferably does) comprise a C-terminal extension as described herein. When a compound of the invention contains an ISVD of the invention that is directed against (human) serum albumin, said the compound of the invention preferably has a half-life (as defined herein) of at least 1 day, preferably at least 3 days, more preferably at least 7 days, such as at least 10 days in the human subject to which the same is/has been administered. Some non-limiting examples of ISVD's of the invention against human serum albumin that can be used for this purpose are as further described herein.

In one aspect, all of the ISVD's or nanobodies present in said compound of the invention are ISVD's of the invention (meaning that they have the amino acid residues/substitutions that are characteristic of the VH domains of the invention as defined herein, i.e. at least 112K or Q, or at least 89T, or at least 89L in combination with 110K or 110Q). When all the ISVD's in the compound of the invention are ISVD's of the invention, they can have the same substitutions (for example all have an S112K or S112Q substitution) or different substitutions (for example, one can have an S1112K or S112Q substitution, and another can have a V89L mutation in combination with T110K or T110Q). Also, usually only the ISVD at the C-terminal end of the compound of the invention will have a C-terminal extension (as the others will likely be linked at their C-terminal end to another ISVD present in the compound).

Thus, in a further aspect, the invention relates a protein, polypeptide or other compound or molecule that comprises or essentially consists of an ISVD of the invention (as further described herein).

The invention further relates to a protein, polypeptide or other compound or molecule that comprises at least one ISVD of the invention and at least one other therapeutic moiety or entity (either linked directly or via a suitable linker).

The invention further relates to a protein, polypeptide or other compound or molecule that comprises at least one ISVD of the invention that is directed against a (human) serum protein (and preferably against human serum albumin) and at least one other therapeutic moiety or entity (either linked directly or via a suitable linker).

The invention further relates to a protein, polypeptide or other compound or molecule that comprises at least two (such as two, three or four) immunoglobulin single variable domains (either linked directly or via a suitable linker), at least one of which is an ISVD of the invention. In this aspect: (i) the ISVD's present may suitably be the same or different; and when they are different they may be directed against the same target (for example, they may have different sequences and/or be directed against different epitopes on the same target) or against two or more different targets (i.e. such that the resulting protein, polypeptide or other compound or molecule is a bi- or multispecific construct); and/or (ii) the ISVD present at the C-terminal end of the protein, polypeptide or other compound or molecule may or may not be an ISVD of the invention (but preferably is); and/or (iii) when an ISVD of the invention is present at the C-terminal end of the protein, polypeptide or other compound or molecule, it preferably has a C-terminal extension as described herein; and/or (iv) essentially all of the ISVD's present in the protein, polypeptide or other compound or molecule may be ISVD's of the invention. Also, when the ISVD's are directed against different targets (as least one of which is a therapeutic target), according to one further aspect at least one of the ISVD's present may be directed against a (human) serum protein such as human serum albumin (and this ISVD may or may not be an ISVD of the invention; and when it is an ISVD of the invention, it is preferably a nanobody against human serum albumin that is as further described herein).

The invention further relates to such a protein, polypeptide or other compound or molecule that comprises or essentially consists of two immunoglobulin single variable domains (either linked directly or via a suitable linker).

The invention further relates to such a protein, polypeptide or other compound or molecule that comprises or essentially consists of three immunoglobulin single variable domains (either linked directly or via a suitable linker).

The invention further relates to such a protein, polypeptide or other compound or molecule comprises or essentially consists of four immunoglobulin single variable domains (either linked directly or via a suitable linker).

The invention further relates to such a protein, polypeptide or other compound or molecule that further comprises at least one moiety, binding domain or binding unit that confers an increased half-life to said protein, polypeptide or other compound or molecule (i.e. compared to the corresponding protein, polypeptide or other compound or molecule without said moiety, binding domain or binding unit). According to a more specific aspect, said at least one moiety, binding domain or binding unit that confers an increased half-life to said protein, polypeptide or other compound or molecule is an immunoglobulin single variable domain, more in particular an immunoglobulin single variable domain that is directed against a serum protein (such as serum albumin), and in particular against a human serum protein (such as human serum albumin); and as described herein may in particular be an ISVD of the invention. Said ISVD against the serum protein may be at the N-terminal end of the protein, polypeptide or other compound or molecule, at the C-terminal end, or (if the protein, polypeptide or other compound or molecule comprises more than two ISVD's) in the middle of the molecule.

The invention further relates to such a protein, polypeptide or other compound or molecule comprises or essentially consists of either:

- two immunoglobulin single variable domains (either linked directly or via a suitable linker), i.e. (said) one immunoglobulin single variable domain (such as a nanobody) that confers an increased half-life and one other immunoglobulin single variable domain (such as a nanobody) that may in particular be directed against a therapeutic target;
- three immunoglobulin single variable domains (either linked directly or via a suitable linker), i.e. (said) one immunoglobulin single variable domain (such as a nanobody) that confers an increased half-life and two other immunoglobulin single variable domains (such as two other nanobodies) that may in particular be directed against a therapeutic target (in which said two other immunoglobulin single variable domains may be directed against the same target, against two different targets or against two different epitopes on the same target); or
- four immunoglobulin single variable domains (either linked directly or via a suitable linker), i.e. (said) one immunoglobulin single variable domain (such as a nanobody) that confers an increased half-life and two other immunoglobulin single variable domains (such as two other nanobodies) that may in particular be directed against a therapeutic target (in which said three other immunoglobulin single variable domains may be directed against the same target, against two or three different targets and/or against two or three different epitopes on the same target).

Again, in such a protein, polypeptide or other compound or molecule: (i) the ISVD's present may suitably be the same or different; and when they are different they may be directed against the same target (for example, they may have different sequences and/or be directed against different epitopes on the same target) or against two or more different targets (i.e. such that the resulting protein, polypeptide or other compound or molecule is a bi- or multispecific construct); and/or (ii) the ISVD present at the C-terminal end of the protein, polypeptide or other compound or molecule may or may not be an ISVD of the invention (but preferably is); and/or (iii) when an ISVD of the invention is present at the C-terminal end of the protein, polypeptide or other compound or molecule, it preferably has a C-terminal extension as described herein; and/or (iv) essentially all of the ISVD's present in the protein, polypeptide or other compound or molecule may be ISVD's of the invention.

The invention further relates to methods for expressing/producing/manufacturing the VH domains of the invention and the compounds of the invention (as further described herein). For example, a VH domain of the invention can be expressed/produced by suitably expressing a nucleic acid that encodes the same in a suitable host organism. Reference is for example made to WO 08/020079 (as well as to some of the other patent applications of applicant/assignee cited herein), that generally describes suitable methods and techniques for expressing/producing Nanobodies, which methods can also suitably be used to express/produce Nanobodies of the invention. Methods for expressing VH domains of the invention other than nanobodies will also be clear to the skilled person based on the disclosure and prior art cited herein. Compounds of the invention can be suitably manufactured/produced by suitably linking (usually via covalent bonds) one or more VH domains of the invention to the one or more further amino acid residues (and/or other groups or moieties) that are to be present in the final compound of the invention, optionally via one or more linkers or spacers. Alternatively, when a compound of the invention is a protein or polypeptide, it can be manufactured/produced by suitably expressing a nucleic acid that encodes the same in a suitable host organism. Reference is again for example made to the general methods described in WO 08/020079 and in some of the other patent applications of applicant/assignee cited herein.

The invention also relates to a nucleotide sequence and/or nucleic acid that encodes a VH domain of the invention or a compound of the invention. Such a nucleic acid can be DNA or RNA; and is preferably DNA and can be in the form of a plasmid or vector. Reference is again for example made to WO 08/020079 and to some of the other patent applications of applicant/assignee cited herein.

The invention also relates to a composition that comprises at least one VH domain of the invention, compound of the invention or nucleic acid encoding either of the same.

The invention further relates to a pharmaceutical composition that comprises an ISV (and preferably a therapeutic ISV) or a protein or polypeptide comprising at least one ISV (and preferably at least one therapeutic ISV), wherein said ISV, protein or polypeptide is as further described herein (i.e. an ISV, protein or polypeptide according to one or more of the aspects described herein, and in particular according to one or more of the aspects described on the preceding pages; and more in particular an ISV, protein or polypeptide that has a C-terminal end/sequence that is according to one or more of the aspects described herein), and at least one suitable carrier, diluent or excipient (i.e. suitable for pharmaceutical use), and optionally one or more further active substances. Such compositions, carriers, diluents or excipients can for example be as described in WO 08/020079 for pharmaceutical compositions that comprise a Nanobody or a protein or polypeptide that comprises at least one Nanobody (and as already mentioned, according to the present invention, the ISV is also preferably a Nanobody).

The invention further relates to an ISV or a protein or polypeptide comprising at least one ISV for use in therapy of a disease in a human being (e.g. a patient in need of such therapy), wherein said ISV, protein or polypeptide is as further described herein (i.e. an ISV, protein or polypeptide according to one or more of the aspects described herein, and in particular according to one or more of the aspects described on the preceding pages; and more in particular an ISV, protein or polypeptide that has a C-terminal end/sequence that is according to one or more of the aspects described herein).

The invention further relates to the use of an ISV or a protein or polypeptide comprising at least one ISV in the preparation of a pharmaceutical composition, wherein said ISV, protein or polypeptide is as further described herein (i.e. an ISV, protein or polypeptide according to one or more of the aspects described herein, and in particular according to one or more of the aspects described on the preceding pages; and more in particular an ISV, protein or polypeptide that has a C-terminal end/sequence that is according to one or more of the aspects described herein).

The invention further relates to a method of treatment which comprises administering to a human subject (e.g to a patient in need of such treatment) an ISV or a protein or polypeptide comprising at least one ISV in the preparation of a pharmaceutical composition, wherein said ISV, protein or polypeptide is as further described herein (i.e. an ISV, protein or polypeptide according to one or more of the aspects described herein, and in particular according to one or more of the aspects described on the preceding pages; and more in particular an ISV, protein or polypeptide that has a C-terminal end/sequence that is according to one or more of the aspects described herein); or a pharmaceutical composition (as described above) that comprises at least one such ISV, protein or polypeptide.

With respect to the above, it will be clear that the therapeutic use of the ISV's, proteins and polypeptides described herein are a very important aspect of the invention, as such therapeutic use (or the clinical development of such ISV's, proteins and polypeptides for such therapeutic use) may involve the use of ADA assays to determine whether said ISV, protein or polypeptide is immunogenic (i.e. can give rise to ADA's when administered to a human subject). In this respect, it will also be clear that concerns about possible immunogenicity will in particular have to be addressed when a therapeutic is either used for longer periods of time (for during weeks, months or years), and/or has a half-life (preferably expressed as t1/2-beta) in a human subject of at least 3 days, such as at least one week, and up to 10 days or more.

Thus, according to one specific aspect, the invention relates to an ISV, protein, polypeptide, compound or molecule of the invention as described herein (or pharmaceutical composition the same) that is intended for treatment of a chronic disease in a human being, and/or such ISV, protein, polypeptide as described herein is intended to be present in the circulation of the subject (i.e. at pharmacologically active levels) to which it is administered (i.e. at a therapeutically active dose) for at least a period of one week, preferably at least two weeks, such as at least a months; and/or such ISV, protein, polypeptide as described herein is such that it has a half-life (preferably expressed as t1/2-beta) in a human subject of at least 3 days, such as at least one week, and up to 10 days or more; and/or such an ISV, protein, polypeptide or pharmaceutical composition as described herein is intended to be administered to a human being as two or more doses that are administered over a period of at least 3 days, such as at least one week, for example at least two weeks or at least one month, or even longer (i.e. at least 3 months, at least 6 months or at least one year), or even chronically administered.

Also, as will be clear to the skilled person based on the disclosure herein, the improvements to VH domains described herein and the resulting improved VH domains will find particular use in proteins, polypeptides or other compounds or molecules that are intended for administration to human subjects (and in particular patients) whose blood/serum contains (or is suspected to contain) pre-existing antibodies of the kind that—according to the present invention—have been found in samples obtained from SLE patients, i.e. pre-existing antibodies that can bind to the C-terminal region of a VH-domain even in the presence of a C-terminal extension as described herein. In particular, the improvements to VH domains described herein and the resulting improved VH domains will find particular use in proteins, polypeptides or other compounds or molecules that are intended to treat or prevent diseases or disorders in such patients. This may be any disease or disorder, but may in particular be a disease or disorder that results in and/or is associated with the presence or emergence of such pre-existing antibodies (one example being SLE, but it is expected that other severe (auto-)-immune disorders may also lead to such pre-existing antibodies. This can be easily ascertained by testing samples obtained from the relevant patient population for the presence of such pre-existing antibodies, essentially in a manner analogous to the tests performed on samples from SLE patients in the Experimental Part below).

Thus, according to one specific aspect, the invention relates to an ISV, protein, polypeptide, compound or molecule of the invention as described herein (or a pharmaceutical composition the same) that is intended for administration to a human subject whose blood contains pre-existing antibodies that can bind to the exposed C-terminal region of a VH domain even when said VH-domain contains a C-terminal extension as described herein (or where the C-terminal end of the VH domain is linked to another protein or polypeptide, such as another ISV, optionally via a suitable linker).

In particular, the invention relates to an ISV, protein, polypeptide, compound or molecule of the invention as described herein (or a pharmaceutical composition the same) for use in the treatment of a disease or disorder in a human subject whose blood contains pre-existing antibodies that can bind to the exposed C-terminal region of a VH domain even when said VH-domain contains a C-terminal extension as described herein (or where the C-terminal end of the VH domain is linked to another protein or polypeptide, such as another ISV, optionally via a suitable linker). Said disease or disorder can be any disease or disorder, but can in particular be a disease or disorder that leads to, results into or otherwise is associated with the presence of such pre-existing antibodies in the blood of such a patient, such as SLE or another (severe) autoimmune disease.

Thus, according to a more specific aspect, the invention relates to an ISV, protein, polypeptide, compound or molecule of the invention as described herein (or a pharmaceutical composition the same) for use in the treatment of a disease or disorder in a human subject/patient, wherein said disease or disorder is a disease or disorder that leads to, results into or otherwise is associated with the presence of pre-existing antibodies in the blood of said human subject/patient that can bind to the exposed C-terminal region of a VH domain even when said VH-domain contains a C-terminal extension as described herein (or where the C-terminal end of the VH domain is linked to another protein or polypeptide, such as another ISV, optionally via a suitable linker). For example, such an ISV, protein, polypeptide, compound or molecule of the invention as described herein (or a pharmaceutical composition the same) for use in the treatment of SLE or another (severe) auto-immune disease in a human subject/patient.

As will be clear to the skilled person, when a protein, polypeptide, compound or molecule is intended for the prevention or treatment of such a disease or disorder, it will contain at least one (such as one, two, three or four) domains, binding units or moieties or entities that are therapeutically active against the relevant disease or disorder (e.g. directed against a target or pathway that is therapeutically relevant for the pertinent disease or disorder). Again, such binding domains or binding units may for example be (other) ISVD's, and according to one aspect may in particular be VH domains or ISVD's of the invention. Another general example of such a protein, polypeptide, compound or molecule is a protein, polypeptide, compound or molecule in which said one or more therapeutic domains, binding units or moieties or entities may not be ISVD's (but for example derived from another scaffold), but that contains a VH domain of the invention to extend the half-life of the same (such as a serum albumin binder as described herein).

In a further aspect, the VH domains, ISVD's or compounds of the invention (as described herein) are directed towards the ion channel Kv1.3. Some preferred, but non-limiting examples of such VH domains, ISVD's or compounds are given in Example 7, and the VH domains against Kv1.3 described in said example (as well as compounds of the invention comprising the same) as well as the specific compounds of the invention against Kv1.3 described in said example form further aspects of the present invention.

For example and without limitation, a compound of the invention that is directed towards Kv1.3 can comprise or essentially consist of a single VH domain—and preferably Nanobody—of the invention directed against Kv1.3 or can comprise or essentially consist of at least two (such as two or three) VH domains—and preferably Nanobodies—of the invention directed against Kv1.3. When such a polypeptide contains two or more VH domains of the invention against Kv1.3, these VH domains can be the same or different, and when they are different they can be directed against the same epitope on Kv1.3 or subunit on Kv1.3 or against different epitopes or subunits.

Again, as generally described herein for the compounds of the invention, such compounds can suitably contain one or more linkers, can contain a C-terminal extension (i.e. as further described herein) and can also contain one or more further binding units or binding domains (or other amino acid sequences or moieties), such as a further ISVD directed against a different target than Kv1.3. For example and without limitation, the compounds of the invention can (also) contain a binding domain or binding unit that provides for extended half-life, such as an ISVD against a serum protein such as serum albumin (for example, a Nanobody against human serum albumin such as a Nanobody of the invention against human serum albumin).

In further aspects, the invention relates to (synthetic) libraries of immunoglobulin variable domain sequences that are as described herein (i.e. containing the amino acid residues/mutations/substitutions as described herein). Such libraries will usually contain at least 100 different sequences, such as at least 1000 different sequences, in particular more than $10^5$ different sequences, more in particular more than $10^6$, such as $10^8$ to $10^{10}$ or more different sequences (meaning in its broadest sense, with at least one amino acid difference between the sequences), usually all with (essentially) the same framework sequences (said framework sequences containing the amino acid residues/mutations indicated herein) and different CDRs (meaning that each sequence in the library has at least "one amino acid difference" in at least one of its CDRs compared to the other sequences in the library).

Synthetic libraries of immunoglobulin single variable domain sequences (for example based on human VH sequences or camelid-derived VHH sequences) and methods of generating/constructing them (including libraries based on pre-determined scaffolds and/or containing one or more specific amino acid residues/mutations in the framework regions) are well known in the art. Reference is for example made to Tanha et al., J. Biol. Chem., Vol. 276, pp. 24774-24780, 2001; Bond et al., J. Mol. Biol. (2003) 332, 643-655; Mandrup et al., PLOS One, October 2013, Volume 8, Issue 10, e76834; Goldman et al., Anal. Chem., 2006, 78, 8245-8255; Hussak et al., Protein Engineering, Design & Selection vol. 25 no. 6 pp. 313-318, 2012; and Chen et al., Methods Mol. Biol., 2009, 525, 81. The techniques described therein (and similar techniques known per se) can be suitably used or adapted for generating the immunoglobulin single variable domain libraries according to the invention.

The ISVD's present in such libraries can suitably contain any suitable CDR's from any suitable source, such as CDR's obtained/generated starting from the immune repertoire from a "naïve" mammal (such as a species of camelid or human sequences), CDR's obtained/generated starting from the immune repertoire from an animal (such as a species of camelid) that has been suitably immunized with an antigen; a fully synthetic CDR repertoire; or a repertoire that has been obtained through techniques such as mutagenesis (for example random mutagenesis or site-specific mutagenesis). Such a library can for example also be a library that has been generated in the course of affinity maturation procedures known per se.

The framework regions of the ISVD's present in such libraries can be suitably derived from any suitable starting sequence/scaffold, for example based on a scaffold that has been derived starting from a VH sequence (such as a human VH sequence) or starting from a nanobody sequence (such as a VHH sequence or a humanized VH sequences). It is also possible that a library contains ISVD's that are derived from two or more different sources or that are based on two or more different scaffolds (for example, because the library has been obtained by combining two or more libraries obtained from different sources or based on different scaffolds).

Also, (the ISVD's present in) the libraries may be in the form of proteins or in the form of a DNA or RNA encoding the relevant ISVD's. For example, the libraries may be in the form of an expression library suitable for screening and/or selection techniques, and may for this purpose for example be in a form that can be displayed using suitable display techniques such as phage display library, a yeast display library or a ribosome display library.

Thus, generally, the invention also relates to libraries (as described herein) containing VH domains of the invention (as further described heerein). Preferably, according to one specific aspect of such a library, the VH domains present all have the same (or essentially the same) framework sequences, but different CDR sequences (again, as mentioned, this means that each of the individual VH domains in the library has at least one amino acid difference in at least one CDR compared to the other VH domains in the library).

In one aspect, such a library of the invention is a library of ISVD's of the invention (as further described herein, including a library of suitable nucleic acids encoding said ISVD's) in which:

- the amino acid residue at position 11 is one of L, V or K; and
- the amino acid residue at position 14 is one of A or P; and
- the amino acid residue at position 41 is one of A or P; and
- the amino acid residue at position 89 is one of T, V or L; and
- the amino acid residue at position 108 is one of Q or L; and
- the amino acid residue at position 110 is one of T, K or Q; and
- the amino acid residue at position 112 is one of S, K or Q;
- in which either (i) the amino acid residue at position 112 is one of K or Q; and/or (ii) the amino acid residue at position 89 is T; and/or (iii) the amino acid residue at position 89 is L and the amino acid residue at position 110 is one of K or Q; and (iv) in each of cases (i) to (iii), the amino acid at position 11 is preferably V. Optionally, the ISVD's present in such a library may also contain a C-terminal extension (as further described herein for the VH domains of the invention) and/or suitably contain a suitable tag (such as a histidine tag).

In another aspect, such a library of the invention is a library of ISVD's of the invention (as further described herein, including a library of suitable nucleic acids encoding said ISVD's) in which:

- the amino acid residue at position 11 is V; and
- the amino acid residue at position 14 is one of A or P; and
- the amino acid residue at position 41 is one of A or P; and
- the amino acid residue at position 89 is one of L; and
- the amino acid residue at position 108 is one of Q or L; and
- the amino acid residue at position 110 is one of T, K or Q; and
- the amino acid residue at position 112 is one of S, K or Q;

Optionally, the ISVD's present in such a library may also contain a C-terminal extension (as further described herein for the VH domains of the invention) and/or suitably contain a suitable tag (such as a histidine tag).

The libraries of the invention may be used for any suitable/intended purpose known per se. For example, they may for example be used for screening and/or selection purpose (or as part of a screening and/or selection process), be used for/as part of affinity maturation purposes or other processes intended to yield improved VH domains, or for example for alanine scanning. In practice, usually, the size, design and other features of the library will be adapted to its intended use, as will be within the skill of the artisan.

Experimental Part

The human samples used in the Experimental Part below were either obtained from commercial sources or from human volunteers (after all required consents and approvals were obtained) and were used in according with the applicable legal and regulatory requirements (including but not limited to those regarding medical secret and patient privacy)

In the Examples below, the binding of pre-existing antibodies that are present in the samples used (i.e. from healthy volunteers, rheumatoid arthritis (RA) patients and SLE patients) to the Nanobodies tested was determined using ProteOn as follows: Binding of pre-existing antibodies on Nanobodies captured on human serum albumin (HSA) was evaluated using the ProteOn XPR36 (Bio-Rad Laboratories, Inc.). PBS/Tween (phosphate buffered saline, pH7.4, 0.005% Tween20) was used as running buffer and the experiments were performed at 25° C. The ligand lanes of a ProteOn GLC Sensor Chip were activated with EDC/NHS (flow rate 30 μl/min) and HSA was injected at 10 μg/ml in ProteOn Acetate buffer pH4.5 (flow rate 100 μl/min) to render immobilization levels of approximately 3200 RU. After immobilization, surfaces were deactivated with ethanolamine HCl (flow rate 30 μl/min). Nanobodies were injected for 2 minutes at 45 μl/min over the HSA surface to render a Nanobody capture level of approximately 200 RU. The samples containing pre-existing antibodies were centrifuged for 2 minutes at 14,000 rpm and supernatant was diluted 1:10 in PBS-Tween20 (0.005%) before being injected for 2 minutes at 45 μl/min followed by a subsequent 400 seconds dissociation step. After each cycle (i.e. before a new Nanobody capture and blood sample injection step) the HSA surfaces were regenerated with a 2 minute injection of HCl (100 mM) at 45 μl/min. Sensorgram processing and data analysis was performed with ProteOn Manager 3.1.0 (Bio-Rad Laboratories, Inc.). Sensorgrams showing pre-existing antibody binding were obtained after double referencing by subtracting 1) Nanobody-HSA dissociation and 2) non-specific binding to reference ligand lane. Binding levels of pre-existing antibodies were determined by setting report points at 125 seconds (5 seconds after end of association). Percentage reduction in pre-existing antibody binding was calculated relative to the binding levels at 125 seconds of a reference Nanobody.

Example 1: S112K Mutation Inhibits Binding of Pre-Existing Antibodies

The influence of a substitution at position 112 on the binding of pre-existing antibodies in human samples to Nanobodies was determined and compared to the influence of a C-terminal alanine extension as described in WO 12/175741.

Two reference compounds (Reference A without a C-terminal alanine extension and Reference B with a C-terminal alanine extension) and variants of these reference compounds with different mutations at position 112 were tested against sera obtained from six different RA patients and eight sera obtained from different healthy human subjects. Binding of pre-existing antibodies in the samples to the Nanobodies tested was measured on ProteOn according to the general protocol outlined above. The results are shown in Table A below.

As can be seen, of the mutations at position 112 that were tested, the S112K mutation gave a reduction of binding of the pre-existing antibodies that were present in the tested sera that was comparable to that of the C-terminal alanine extension (even without the C-terminal alanine extension being present in the S112K variant). Similar results were obtained with three human plasma samples (data not shown).

TABLE A comparison of mutations at position 112 to a C-terminal alanine extension on binding of pre-existing antibodies present in sera from RA patients and human volunteers

| | RA sera | | | | | | | | | healthy human sera | | | | |
|---|---|---|---|---|---|---|---|---|---|---|---|---|---|---|
| | Average binding on Reference A (RU) | | | | | | | | | | | | | |
| Reference A | 75 | 96 | 44 | 11 | 117 | 141 | 242 | 81 | 121 | 179 | 93 | 92 | 91 | 92 |
| | Inhibition compared to average binding on Reference A (%) | | | | | | | | | | | | | |
| Reference A | 0 | 0 | 0 | 0 | 0 | 0 | 0 | 0 | 0 | 0 | 0 | 0 | 0 | 0 |
| Reference B | 70 | 90 | 100 | 88 | 84 | 97 | 53 | 78 | 83 | 93 | 93 | 81 | 86 | 86 |
| Reference A (S112E) | 51 | 67 | 63 | 65 | 66 | 84 | 31 | 82 | 72 | 59 | 73 | 100 | 74 | 70 |
| Reference A (S112F) | 75 | 51 | 85 | 100 | 79 | 39 | 56 | 86 | 69 | 60 | 78 | 93 | 76 | 79 |
| Reference A (S112K) | 88 | 88 | 94 | 100 | 94 | 100 | 86 | 93 | 87 | 87 | 95 | 100 | 84 | 91 |
| Reference A (S112L) | 69 | 45 | 63 | 54 | 50 | 81 | 37 | 74 | 59 | 42 | 75 | 97 | 68 | 83 |

Example 2: Influence of S112K Mutation on Binding of Pre-Existing Antibodies that are Present in Human SLE Samples The same Nanobody variants as used in Example 1 were tested for binding by pre-existing antibodies from 7 serum samples obtained from patients who were confirmed positive for systemic lupus erythemathosus (SLE). For comparison, plasma samples from two healthy human volunteers were included.

Binding of pre-existing antibodies in the samples to the Nanobodies tested was measured on ProteOn according to the general protocol outlined above. The results are shown in Table B below.

As can be seen from a comparison of the binding data for Reference A and Reference B and nanobodies of the invention, the samples obtained from some of the SLE patients appear to contain certain pre-existing antibodies that can still bind to Nanobodies even in the presence of a C-terminal alanine residue (the C-terminal alanine residue did essentially prevent/remove (partially or essentially fully) all binding of the pre-existing antibodies that were present in the plasma samples from healthy volunteers).

It can further be seen that the binding of these pre-existing antibodies from SLE samples could be greatly reduced by mutations at positions 11 and 112 (and in case of position 112, in particular S112K).

TABLE B comparison of mutations at positions 11 and 112 to a C-terminal alanine extension on binding of pre-existing antibodies present in sera from SLE patients

| | Serum samples obtained from SLE patients | | | | | | | Plasma samples obtained from healthy volunteers | |
|---|---|---|---|---|---|---|---|---|---|
| | Average binding on Reference A (RU) | | | | | | | | |
| Reference A | 45 | 61 | 38 | 40 | 43 | 20 | 69 | 128 | 171 |
| | Inhibition compared to binding on Reference A (%) | | | | | | | | |
| Reference B | 20 | 16 | 13 | 45 | 53 | 86 | 101 | 95 | 90 |
| Reference A (L11E) | 63 | 88 | 117 | 61 | 87 | 88 | 92 | 68 | 21 |
| Reference A (L11K) | 87 | 97 | 107 | 54 | 106 | 79 | 102 | 100 | 61 |
| Reference A (L11V) | 68 | 84 | 49 | 56 | 95 | 91 | 21 | 23 | 6 |
| Reference A (L11Y) | 27 | 71 | 111 | 37 | 84 | 74 | 72 | 13 | 3 |
| Reference A (S112E) | 13 | 56 | 91 | 77 | 74 | 91 | 94 | 84 | 22 |
| Reference A (S112F) | −6 | 18 | 26 | −13 | 62 | 69 | 117 | 74 | 43 |
| Reference A (S112K) | 71 | 77 | 105 | 80 | 116 | 86 | 120 | 87 | 62 |
| Reference A (S112L) | −36 | 36 | 48 | −24 | 123 | 19 | 84 | 91 | 3 |

Example 3: Influence of Combined Framework Mutations and C-Terminal Extensions on Binding of Pre-Existing Antibodies that are Present in Human SLE Samples Four different Nanobodies (with specific framework mutations and with or without C-terminal alanine extension) were tested for binding of pre-existing antibodies from 5 serum samples obtained from patients who were confirmed positive for systemic lupus erythemathosus (SLE). For comparison, one plasma sample from a healthy human volunteer was included.

Binding of pre-existing antibodies in the samples to the Nanobodies tested was measured on ProteOn according to the general protocol outlined above. The results are shown in Tables C and D below.

As can be seen from a comparison of the binding data for Reference A and Reference B, the samples obtained from SLE patients appear to contain a certain pre-existing antibodies that can still bind to Nanobodies even in the presence of a C-terminal alanine residue (the C-terminal alanine residue did essentially prevent/remove all binding of the pre-existing antibodies that were present in the plasma samples from the healthy volunteer).

It can further be seen that the binding of these pre-existing antibodies from SLE samples could be greatly reduced by mutations at positions 11 and 112 (and in case of position 112, in particular S112K).

Example 4: Influence of a V89T Mutation on Binding of Pre-Existing Antibodies in Samples from SLE Patients As described herein, samples obtained from certain SLE patients appear to contain pre-existing antibodies/factors that can bind to the exposed C-terminal end of a VH domain, even when a C-terminal extension is present. It was investigated whether a V89T mutation could reduce or prevent/remove such binding, with or without the presence of a C-terminal extension. The results are also shown in Tables C and E below.

As can be seen, a V89T mutation could essentially prevent/remove binding of pre-existing antibodies that are present in samples obtained from SLE patients, to a similar degree as an S112K mutation. However, as can be seen from comparing the data given in Tables C and E for nanobodies with a V89T mutation without a C-terminal extension with similar nanobodies with an S112K mutation and without a C-terminal extension, having a mutation at position 112 in a nanobody without a C-terminal extension generally reduces binding of pre-existing antibodies in samples from a healthy volunteer to a larger degree than a V89T mutation (i.e. 100%, 85% and 64% of S112K nanobodies vs. 9%, 11% and 16% for V89T nanobodies, respectively). For this reason, the use of a mutation at position 112 (and in particular S112K or S112K) will often be preferred over the use of a mutation at position 89 (such as V89T).

However, as can also be seen from the data in Tables C and E, adding a C-terminal alanine to a V89T nanobody completely prevented/removed the binding of pre-existing antibodies in a sample obtained from healthy volunteers, and for this reason a combination of a V89T mutation and a C-terminal extension as described herein will usually be preferred (i.e. over the use of a V89T without C-terminal extension) if the V89T nanobody or VH domain has, or is intended to have, an exposed C-terminal region in the protein or polypeptide in which it will be present (for example, because if forms the C-terminal end of the same).

TABLE C influence of different mutations of binding by pre-existing antibodies in samples obtained from SLE patients and human volunteers

| | Mutation(s) | | | | | Samples obtained from SLE patients | | | | | Sample obtained from healthy volunteer |
|---|---|---|---|---|---|---|---|---|---|---|---|
| | L11K | L11V | V89T | S112K | 114A | SLE25 | SLE37 | SLE39 | SLE41 | NB13025-14 | 004-030-ABL-02 |
| Average binding to Reference A | | | | | | | | | | | |
| Average binding for Reference A | | | | | | 38 | 66 | 30 | 41 | 45 | 175 |
| Inhibition compared to average binding to Reference A captured on HSA (%) | | | | | | | | | | | |
| Reference A + V89T, no C-terminal extension | | x | x | | | 100 | 98 | 100 | 100 | 98 | 9 |
| Reference A + V89T + C-terminal alanine | | x | x | | x | 97 | 98 | 100 | 98 | 100 | 100 |
| Reference A + S112 K, no C-terminal extension | X | | | x | | 100 | 100 | 100 | 100 | 98 | 100 |
| Reference A + S 112K + C-terminal alanine (*) | X | | | x | x | 100 | 100 | 100 | 99 | 99 | 100 |

(*) Note:
this Nanobody was also used to generate the data shown in FIG. 3 and Table F (see below)

TABLE D influence of different mutations of binding by pre-existing antibodies in samples obtained from SLE patients and human volunteers

| | Mutation | | | | Samples obtained from SLE patients | | | | | Sample obtained from healthy volunteer |
|---|---|---|---|---|---|---|---|---|---|---|
| | L11V | V89L | S112Q | 114A | SLE25 | SLE37 | SLE39 | SLE41 | NB13025-14 | 004-030-ABL-02 |
| Average binding to Reference A | | | | | | | | | | |
| Average binding for Reference A | | | | | ND | 71 | 51 | ND | 41 | 180 |
| Inhibition compared to average binding to Reference A captured on HSA (%) | | | | | | | | | | |
| Reference A + V89L + S 112Q + C-terminal alanine | | x | x | x | ND | 100 | 100 | ND | 100 | 97 |

TABLE D-continued influence of different mutations of binding by pre-existing antibodies in samples obtained from SLE patients and human volunteers

| | Mutation | | | | Samples obtained from SLE patients | | | | | Sample obtained from healthy volunteer |
|---|---|---|---|---|---|---|---|---|---|---|
| | L11V | V89L | S112Q | 114A | SLE25 | SLE37 | SLE39 | SLE41 | NB13025-14 | 004-030-ABL-02 |
| Reference A + L11V + S 112Q + C-terminal alanine | x | | x | x | ND | 100 | 100 | ND | 100 | 99 |
| Reference A + S 112Q + C-terminal alanine | | | x | x | ND | 92 | 85 | ND | 94 | 100 |

TABLE E influence of different mutations on binding by pre-existing antibodies in samples from SLE patients and human volunteers

| | Mutation(s) | | | | | Samples obtained from SLE patients | | | | | Sample from healthy volunteer |
|---|---|---|---|---|---|---|---|---|---|---|---|
| | L11V | V89L | V89T | S112K | 114A | SLE25 | SLE37 | SLE39 | SLE41 | NB13025-14 | 004-030-ABL-02 |
| Average binding to Reference A | | | | | | | | | | | |
| Reference A | | | | | | 28 | 44 | 26 | 33 | 30 | 151 |
| Inhibition compared to average binding to Reference A captured on HSA (%) | | | | | | | | | | | |
| Reference A + V89L, no C-terminal extension | | x | | | | 77 | 64 | 53 | 63 | 41 | 35 |
| Reference A + V89L + C-terminal alanine | | x | | | x | 35 | 27 | 63 | 42 | 46 | 83 |
| Reference A + V89T, no C-terminal extension | | | x | | | 68 | 12 | 84 | 100 | 71 | 11 |
| Reference A + V89T + C-terminal alanine | | | x | | x | 46 | 35 | 71 | 100 | 97 | 99 |
| Reference A + V89T + L11V, no C-terminal extension | x | | x | | | 100 | 97 | 100 | 100 | 100 | 16 |
| Reference A + V89T + L11V + C-terminal alanine (*) | x | | x | | x | 100 | 100 | 100 | 100 | 100 | 67 |
| Reference A + S112K + V89L, no C-terminal extension | | x | | x | | 100 | 100 | 100 | 100 | 100 | 85 |
| Reference A + S112K + V89L C-terminal alanine | | x | | x | x | 100 | 100 | 100 | 100 | 100 | 100 |
| Reference A + S112K + L11V, no C-terminal extension | x | | | x | | 100 | 100 | 100 | 100 | 100 | 64 |
| Reference A + S112K + L11V + C-terminal alanine | x | | | x | x | 100 | 100 | 100 | 100 | 100 | 100 |

(*) Note:
this Nanobody was also used to generate the data shown in FIG. 4 and Table G (see below)

To confirm that the results/findings from the table above are broadly applicable, representative Nanobodies with S112K and/or V89T mutations were tested against a test panel of 96 (S112k) and 129 (V89T) human serum samples. Binding was determined on ProteOn using the protocol set out above.

Figure 4:
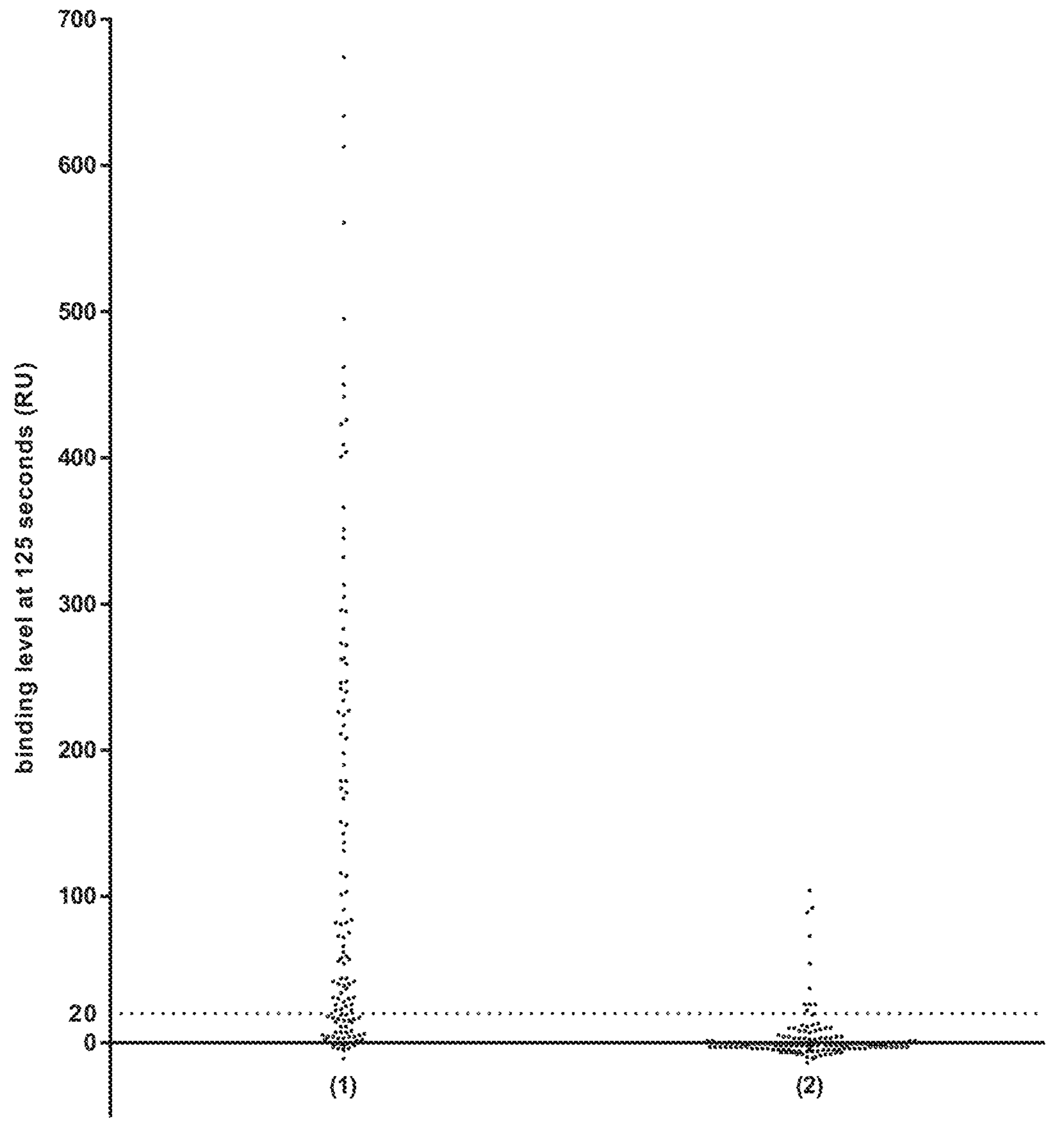
FIG. 4 is a plot showing data points obtained in Example 4 when 129 serum samples were tested for binding a representative Nanobody with an V89T mutation (Reference A+L11V+V89T+C-terminal alanine, indicated as (2) in FIG. 4), compared to a reference Nanobody without an V89T mutation (Reference A, SEQ ID NO: 44, indicated as (1) in FIG. 4)

The results are summarized FIG. 3 and Table F (representative Nanobody with an S112K mutation) and FIG. 4 and Table G (representative Nanobody with a V89T mutation).

In FIG. 3, a Nanobody with an S112K mutation (Reference A+S112K+C-terminal alanine—see Table C above) was compared to a reference Nanobody (Reference A; SEQ ID NO:44). The Nanobody with the S112K mutation and Reference A were both tested against each of the serum samples, and the binding level at 125 seconds (RU) was determined. The data was then plotted in FIG. 3, with each point presenting the binding measured in one sample for either Reference A (indicated as (1) in FIG. 3) or for the S112K mutant (indicated as (2) in FIG. 3). The dotted line indicates a measured binding level of 20 RU.

The same data is also represented numerically in Table F, which mentions—for Reference A and the S112K mutant, respectively—the total number of samples tested that gave a level of binding at 125 seconds of more than 20RU, less than 20 RU (i.e. between 0 and 20 RU) and less than 10 RU.

As can be seen from the data plotted in FIG. 3 and shown in Table F, for Reference A, more than half of the 96 samples tested gave a binding level of more than 20 RU (in some cases, as high as 150-200 RU), indicating that the pre-existing antibodies present in the sample were binding to Reference A. By comparison, for the S112K mutant, no sample gave a binding level of more than 20 RU (and most less than 10 RU), indicating that the S122K mutation was essentially capable of reducing/preventing binding of the pre-existing antibodies in all of the 96 samples tested.

A similar plot and similar data is shown in FIG. 4 and Table G, respectively, for a representative Nanobody with a V89T mutation (Reference A+L11V+V89T+C-terminal alanine; see Table E above), tested against 129 serum samples and again compared to Reference A (indicated by (1) in FIG. 4; the V89T mutant is indicated by (2) in FIG. 4). Again, from the plot in FIG. 4 and the data in Table G, it can be seen that with a few exceptions (i.e. less than 10% of samples tested, which then each gave an absolute binding value after 125 seconds of about 100 RU or less), the V89T mutation was capable of reducing/preventing binding of the pre-existing antibodies in most of the 129 samples tested, whereas the reference without the V89T mutation was bound by pre-existing antibodies in most of the samples tested.

TABLE F testing of representative Nanobody with S112K mutation against 96 serum samples.

| Nanobody tested | Binding level at 125 seconds <10 RU | Binding level at 125 seconds <20 RU | Binding level at 125 seconds >20 RU |
|---|---|---|---|
| Reference A | 34 | 41 | 55 |
| Reference A + S112K + C-terminal alanine | 92 | 96 | 0 |

TABLE G testing of Nanobody mutants with V89L and/or T100K/Q mutations against 129 serum samples.

| Nanobody tested | Binding level at 125 seconds <10 RU | Binding level at 125 seconds <20 RU | Binding level at 125 seconds >20 RU |
|---|---|---|---|
| Reference A | 27 | 40 | 89 |
| Reference A + L11V + V89T + C-terminal alanine | 110 | 119 | 10 |

Example 5: Influence of a V89L Mutation Combined with a T110K or T110Q Mutation on Binding of Pre-Existing Antibodies in Samples from SLE Patients As described herein, samples obtained from certain SLE patients appear to contain pre-existing antibodies/factors that can bind to the exposed C-terminal end of a VH domain, even when a C-terminal extension is present. It was investigated whether a V89L and/or a T110Q or T110K mutation (or a combination thereof) could reduce or prevent/remove such binding, with or without the presence of a C-terminal extension. The results are also shown in Tables H and I, which present the data from two separate experiments (Table D above also shows data for an S112Q mutation of the invention combined with a V89L mutation). The Nanobodies used in Table I were also used in generating the data shown in FIG. 5 and Table J.

TABLE H influence of different mutations on binding by pre-existing antibodies in samples from SLE patients and human volunteers

| | Mutation(s) | | | | | Samples obtained from SLE patients | | | | | Sample from healthy volunteer |
|---|---|---|---|---|---|---|---|---|---|---|---|
| | L11V | V89L | T110K | T110Q | 114A | SLE25 | SLE37 | SLE39 | SLE41 | NB13025-14 | 004-030-ABL-02 |
| Average binding to Reference A | | | | | | | | | | | |
| Reference A | | | | | | 28 | 44 | 26 | 33 | 30 | 151 |
| Inhibition compared to average binding to Reference A captured on HSA (%) | | | | | | | | | | | |
| Reference A + V89L, no C-terminal extension | | x | | | | 77 | 64 | 53 | 63 | 41 | 35 |
| Reference A + V89L + C-terminal alanine | | x | | | x | 35 | 27 | 63 | 42 | 46 | 83 |
| Reference A + L11V + V89L, no C-terminal extension | x | x | | | | 100 | 100 | 8 | 95 | 100 | 29 |
| Reference A + L11V + V89L + C-terminal alanine (*) | x | x | | | x | 94 | 70 | 100 | 78 | 100 | 89 |
| Reference A + V89L + T110K, no C-terminal extension | | x | x | | | 100 | 77 | 100 | 100 | 100 | 65 |
| Reference A + V89L + T110K, C-terminal alanine | | x | x | | x | 96 | 70 | 100 | 100 | 100 | 100 |
| Reference A + L11V + T110K, no C-terminal extension | x | | x | | | 100 | 0 | 100 | 100 | 100 | 43 |
| Reference A + L11V + T110K + C-terminal alanine | x | | x | | x | 96 | 0 | 100 | 100 | 100 | 99 |

Figure 5:
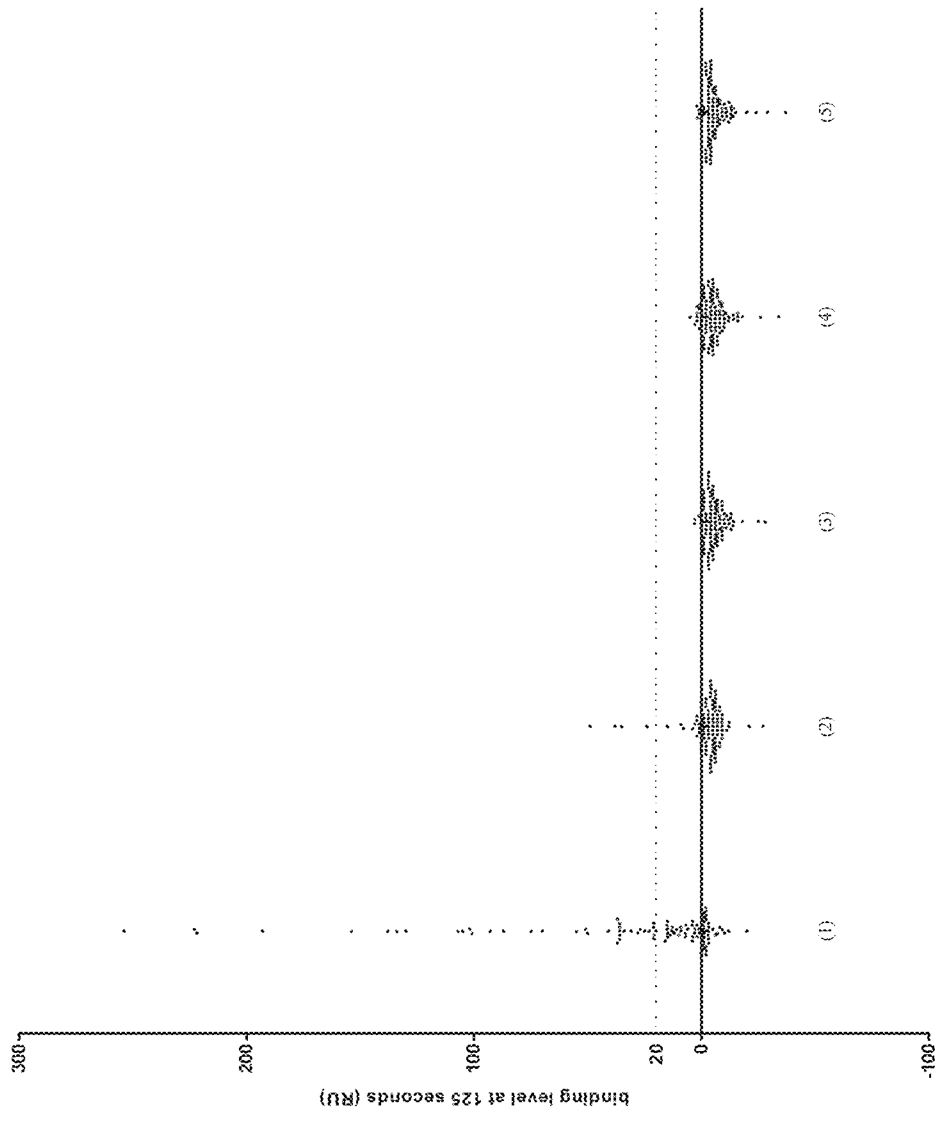
FIG. 5 is a plot showing data points obtained in Example 5 when 100 serum samples were tested for binding representative Nanobodies with V89L, T110K and/or T110Q mutations (Reference A+L11V+V89L+C-terminal Ala, indicated as (2) in FIG. 5; Reference A+L11V+V89L+T110K+C-terminal Ala, indicated as (3) in FIG. 5; Reference A+L11V+V89L+T110Q+C-terminal Ala, indicated as (4) in FIG. (5) and Reference A+L11V+T87A+V89L+C-terminal Ala, indicated as (5) in FIG. 5), compared to a reference Nanobody without any of these mutations (Reference A, SEQ ID NO: 44, indicated as (1) in FIG. 5).

(*) This Nanobody was also used in generating the data shown in FIG. 5 and Table J

TABLE I influence of different mutations on binding by pre-existing antibodies in samples from SLE patients and human volunteers.

| | Mutation(s) | | | | | | Samples obtained from SLE patients | | | | |
|---|---|---|---|---|---|---|---|---|---|---|---|
| | L11V | T87A | V89L | T110K | T110Q | 114A | SLE25 | SLE37 | SLE39 | SLE41 | NB13025-14 |
| Average binding to Reference A | | | | | | | | | | | |
| Reference A | | | | | | | 50 | 72 | 55 | 56 | 58 |
| Inhibition compared to average binding to Reference A captured on HSA (%) | | | | | | | | | | | |
| Reference A + L11V + V89L + C-terminal alanine | x | | x | | | x | 100 | 100 | 98 | 100 | 99 |
| Reference A + L11V + V89L + T110K + C-terminal alanine | x | | x | x | | x | 100 | 81 | 98 | 99 | 98 |
| Reference A + L11V + V89L + T110Q + C-terminal alanine | x | | x | | x | x | 100 | 100 | 87 | 98 | 81 |
| Reference A + L11V + T87A + V89L + C-terminal alanine | x | x | x | | | x | 100 | 100 | 100 | 100 | 100 |

To confirm that the results/findings from the table above are broadly applicable, representative Nanobodies with V89L, T110K and/or T110Q mutations were again tested against a panel of 99 human serum samples. Binding data was again obtained and plotted as indicated in Example 4 for the results and data shown in FIGS. 3 and 4 and Tables F and G.

The Nanobodies tested were (the numbers correspond to the numbering used in FIG. 5): (1) Reference A; (2) Reference A+L11V+V89L+C-terminal Ala; (3) Reference A+L11V+V89L+T110K+C-terminal Ala; (4) Reference A+L11V+V89L+T110Q+C-terminal Ala; (5) Reference A+L11V+T87A+V89L+C-terminal Ala. The results are shown in FIG. 5 and Table I.

As can be seen, introducing the mutations tested again greatly reduced the number of samples in which the pre-existing antibodies were capable of binding the Nanobody tested. It can also be seen that, for Nanobody (2) in FIG. 5 (Reference A+L11V+V89L+C-terminal Ala), still some of the samples showed binding of pre-existing antibodies after 125 seconds at levels of more than 20 RU (but already much less than 100 RU). However, when the V89L mutation was combined with a T110K mutation (Nanobody (3)) or a T100Q mutation (Nanobody (4)), then essentially all of the 99 samples tested showed a binding level of less than 20RU (and in fact less than 10RU, see Table J).

TABLE J testing of representative Nanobodies with V89L, T110K and/or T110Q mutations against 99 serum samples.

| Nanobody tested | Binding level at 125 seconds <10 RU | Binding level at 125 seconds <20 RU | Binding level at 125 seconds >20 RU |
|---|---|---|---|
| Reference A | 52 | 64 | 35 |
| Reference A + L11V + V89L + C-terminal Ala | 94 | 95 | 4 |
| Reference A + L11V + V89L + T110K + C-terminal Ala | 99 | 99 | 0 |
| Reference A + L11V + V89L + T110Q + C-terminal Ala | 99 | 99 | 0 |

TABLE J-continued testing of representative Nanobodies with V89L, T110K and/or T110Q mutations against 99 serum samples.

| Nanobody tested | Binding level at 125 seconds <10 RU | Binding level at 125 seconds <20 RU | Binding level at 125 seconds >20 RU |
|---|---|---|---|
| Reference A + L11V + T87A + V89L + C-terminal Ala | 99 | 99 | 0 |

Example 6: Testing of Multivalent Constructs for Binding of Pre-Existing, Antibodies Multivalent constructs are made based on the following nanobodies:

Nanobody a (Directed Against a Therapeutic Target):

```
                                              (SEQ ID NO: 92)
EVQLVESGGGLVQPGGSLRLSCAASGRTFNNYAMGWFRQAPGKEREFVAA

ITRSGVRSGVSAIYGDSVKDRFTISRDNAKNTLYLQMNSLRPEDTAVYYC

AASAIGSGALRRFEYDYSGQGTLVTVSS
```

Nanobody B (Directed Against Serum Albumin):

```
                                              (SEQ ID NO: 93)
EVQLVESGGGLVQPGNSLRLSCAASGFTFSSFGMSWVRQAPGKGLEWVSS

ISGSGSDTLYADSVKGRFTISRDNAKTTLYLQMNSLRPEDTAVYYCTIGG

SLSRSSQGTLVTVSS
```

Nanobody C (Directed Against a Therapeutic Target):

```
                                              (SEQ ID NO: 94)
EVQLVESGGGLVQPGGSLRLSCAASRSIGRLDRMGWYRHRPGEPRELVAT

ITGGSSINYGDSVKGRFTISIDNSKNTVYLQMNSLRPEDTAVYYCNFNKY

VTSRDTWGQGTLVTVSS
```

The constructs made are listed in Table K below (with in each case, the introduced substitution(s) in the relevant nanobody (if any) mentioned between parentheses. "HIS6"

denotes an N-terminal his-tag of 6 histidine residues, and "—Ala" denotes a C-terminal extension of 1 alanine residue).

TABLE K

| multivalent constructs tested |
| --- |
| HIS6-Nanobody A(E1D, L11V, S112K)-35GS-Nanobody B-Ala |
| HIS6-Nanobody A(E1D, L11V, S112K)-35GS-Nanobody B(L11V, S112K)-Ala |
| HIS6-Nanobody A(E1D)-35GS-Nanobody B |
| HIS6-Nanobody A(E1D)-35GS-Nanobody B-Ala |
| HIS6-Nanobody A(E1D, L11V, S112K)-35GS-Nanobody B(L11V, S112K) |
| HIS6-Nanobody A(E1D, S112K)-35GS-Nanobody B(S112K)-Ala |
| HIS6-Nanobody A(E1D, S112Q)-35GS-Nanobody B(S112Q)-Ala |
| HIS6-Nanobody A(E1D, V89L, S112K)-35GS-Nanobody B(V89L, S112K)-Ala |
| HIS6-Nanobody A(E1D, L11V, S112Q)-35GS-Nanobody B(L11V, S112Q)-Ala |
| HIS6-Nanobody B(E1D)-35GS-Nanobody A |
| HIS6-Nanobody B(E1D)-35GS-Nanobody A-Ala |
| HIS6-Nanobody A(E1D)-35GS-Nanobody B(L11V, S112K)-Ala |
| HIS6-Nanobody B(E1D, L11V, S112K)-35GS-Nanobody A-Ala |
| HIS6-Nanobody B(E1D,)-35GS-Nanobody A(L11V, S112K)-Ala |
| HIS6-Nanobody A(E1D, V89L, S112Q)-35GS-Nanobody B(V89L, S112Q)-Ala |
| HIS6-Nanobody B(E1D, L11V, S112K)-35GS-Nanobody A(L11V, S112K)-Ala |
| HIS6-Nanobody B(S112K)-Ala |
| Nanobody B(L11V, S112K)-Ala |
| Nanobody B(L11V, S112Q)-Ala |
| Nanobody B(S112Q)-Ala |
| HIS6-Nanobody A(E1D, S112K)-35GS-Nanobody A(S112K)-35GS-Nanobody B(S112K)-Ala |
| HIS6-Nanobody A(E1D, S112Q)-35GS-Nanobody A(S112Q)-35GS-Nanobody B(S112Q)-Ala |
| HIS6-Nanobody A(E1D, L11V, S112K)-35GS-Nanobody A(L11V, S112K)-35GS-Nanobody B(L11V, S112K)-Ala |
| HIS6-Nanobody A(E1D, V89L, S112K)-35GS-Nanobody A(V89L, S112K)-35GS-Nanobody B(V89L, S112K)-Ala |
| HIS6-Nanobody A(E1D)-35GS-Nanobody A-35GS-Nanobody B |
| HIS6-Nanobody A(E1D)-35GS-Nanobody A -35GS-Nanobody B-Ala |
| Nanobody C(E1D)-9GS-AlaLB11-9GS-Nanobody C |
| HIS6-Nanobody A(E1D, L11V, S112K)-35GS-Nanobody A(L11V, S112K)-35GS-Nanobody B-Ala |
| HIS6-Nanobody C(E1D, L11V, S112K)-9GS-Nanobody B(L11V, S112K)-9GS-Nanobody C(L11V, S112K)-Ala |
| Nanobody C(E1D)-9GS-AlaLB11-9GS-Nanobody C-Ala |
| HIS6-Nanobody A(E1D, L11V, S112Q)-35GS-Nanobody A(L11V, S112Q)-35GS-Nanobody B(L11V, S112Q)-Ala |
| HIS6-Nanobody A(E1D, V89L, S112Q)-35GS-Nanobody A(V89L, S112Q)-35GS-Nanobody B(V89L, S112Q)-Ala |
| HIS6-Nanobody C(E1D, S112K)-9GS-Nanobody B(S112K)-9GS-Nanobody C(S112K)-Ala |
| HIS6-Nanobody C(E1D, S112Q)-9GS-Nanobody B(S112Q)-9GS-Nanobody C(S112Q)-Ala |
| HIS6-Nanobody C(E1D, L11V, S112Q)-9GS-Nanobody B(L11V, S112Q)-9GS-Nanobody C(L11V, S112Q)-Ala |
| HIS6-Nanobody C(E1D, V89L, S112K)-9GS-Nanobody B(V89L, S112K)-9GS-Nanobody C(V89L, S112K)-Ala |
| HIS6-Nanobody C(E1D, V89L, S112Q)-9GS-Nanobody B(V89L, S112Q)-9GS-Nanobody C(V89L, S112Q)-Ala |
| HIS6-Nanobody A(E1D, L11V, A14P, R39Q, K83R, V89L, T91Y, Q108L)-35GS-Nanobody B(L11V, R30S, E44G, P45L, K83R, V89L, Q108L)-Ala |
| HIS6-Nanobody A(E1D, L11V, A14P, R39Q, K83R, T87A, V89L, T91Y, Q108L)-35GS-Nanobody B(L11V, R30S, E44G, P45L, K83R, T87A, V89L, Q108L)-Ala |
| HIS6-Nanobody A(E1D, L11V, A14P, R39Q, K83R, V89L, T91Y, Q108L, T110Q)-35GS-Nanobody B(L11V, R30S, E44G, P45L, K83R, V89L, Q108L, T110Q)-Ala |
| HIS6-Nanobody A(E1D, L11V, A14P, R39Q, K83R, V89L, T91Y, Q108L, T110K)-35GS-Nanobody B(L11V, R30S, E44G, P45L, K83R, V89L, Q108L, T110K)-Ala |
| HIS6-Nanobody A(E1D, L11V, A14P, R39Q, K83R, V89L, T91Y, Q108L)-35GS-Nanobody A(E1D, L11V, A14P, R39Q, K83R, V89L, T91Y, Q108L)-35GS-Nanobody B(L11V, R30S, E44G, P45L, K83R, V89L, Q108L)-Ala |
| HIS6-Nanobody A(E1D, L11V, A14P, R39Q, K83R, T87A, V89L, T91Y, Q108L)-35GS-Nanobody A(E1D, L11V, A14P, R39Q, K83R, T87A, V89L, T91Y, Q108L)-35GS-Nanobody B(L11V, R30S, E44G, P45L, K83R, T87A, V89L, Q108L)-Ala |
| HIS6-Nanobody A(E1D, L11V, A14P, R39Q, K83R, V89L, T91Y, Q108L, T110Q)-35GS-Nanobody A(E1D, L11V, A14P, R39Q, K83R, V89L, T91Y, Q108L, T110Q)-35GS-Nanobody B(L11V, R30S, E44G, P45L, K83R, V89L, Q108L, T110Q)-Ala |
| HIS6-Nanobody A(E1D, L11V, A14P, R39Q, K83R, V89L, T91Y, Q108L, T110K)-35GS-Nanobody A(E1D, L11V, A14P, R39Q, K83R, V89L, T91Y, Q108L, T110K)-35GS-Nanobody B(L11V, R30S, E44G, P45L, K83R, V89L, Q108L, T110K)-Ala |

Representative multivalent constructs were tested for binding by pre-existing antibodies that are present in a blood or serum sample obtained from patients with SLE and healthy volunteers. Both were determined using ProteOn, essentially as described above.

Figure 6:
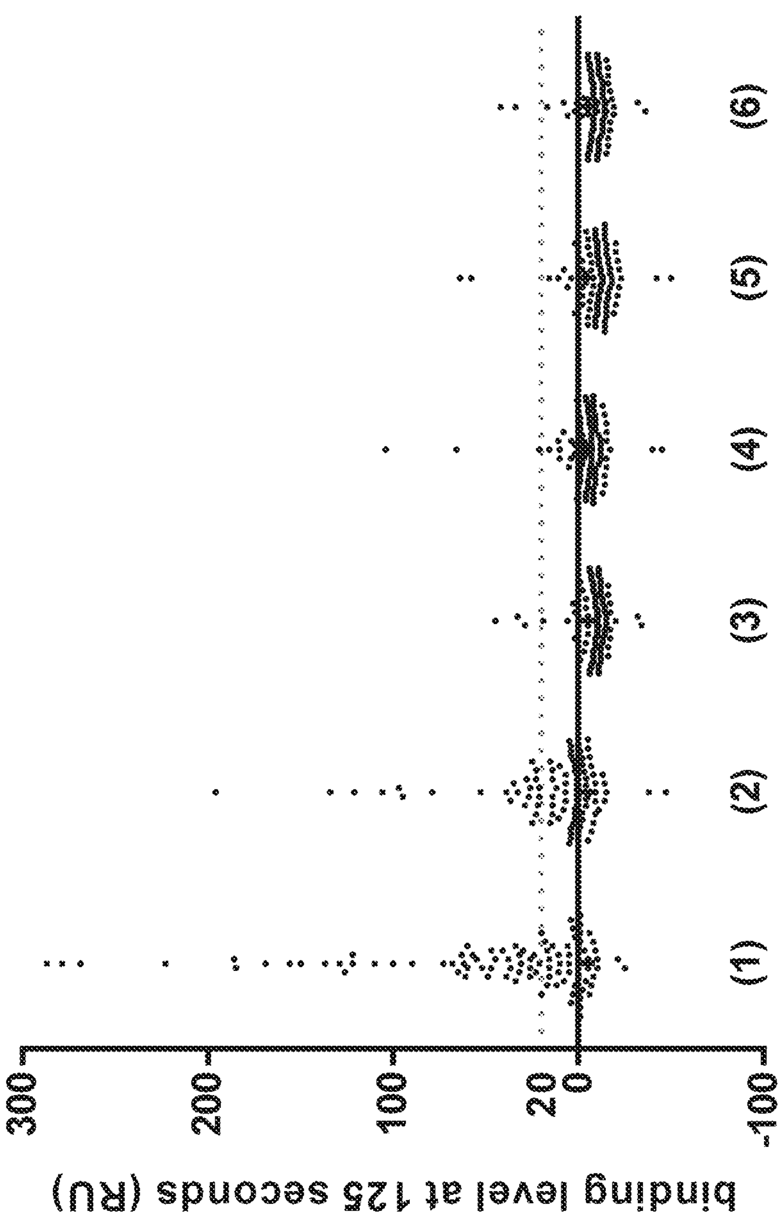
FIG. 6 is a plot showing data points obtained in Example 6 when 98 serum samples obtained from healthy volunteers were tested for binding representative trivalent Nanobody constructs. Each dot represents a data point collected by testing of the indicated construct against one of the 98 serum samples. Legenda: (1)=Reference X (Nanobody A-35GS-Nanobody A-35GS-Nanobody B); (2)=Reference X+C-terminal Ala; (3)=Reference X+L11V+V89L+C-terminal Ala; (4)=Reference X+L11V+T87A+V89L+C-terminal Ala; (5)=Reference X+L11V+V89L+T110K+C-terminal Ala; (6)=Reference X+L11V+V89L+T110Q+C-terminal Ala.
Figure 7:
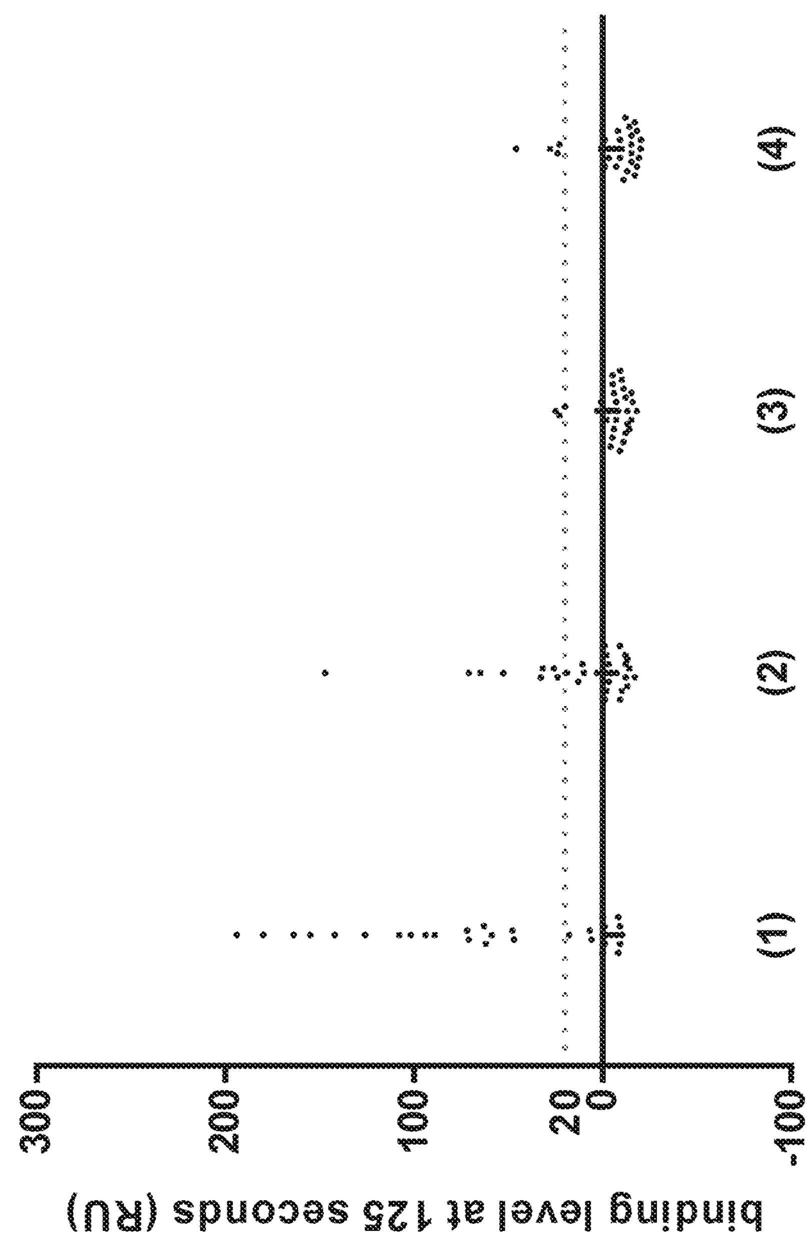
FIG. 7 is a plot showing data points obtained in Example 6 when 30 serum samples obtained from healthy volunteers (samples selected for high titers of pre-existing antibodies or presence of pre-existing antibodies with high degree of binding even in the presence of a C-terminal alanine extension) were tested for binding representative trivalent Nanobody constructs. Each dot represents a data point collected by testing of the indicated construct against one of the 30 serum samples. Legenda: (1)=Reference X+C-terminal Ala; (2)=Reference X+L11V+V89L+C-terminal Ala; (4)=Reference X+L11V+T87A+V89L+C-terminal Ala; (4)=Reference X+L11V+V89L+T110K+C-terminal Ala.
Figure 8:
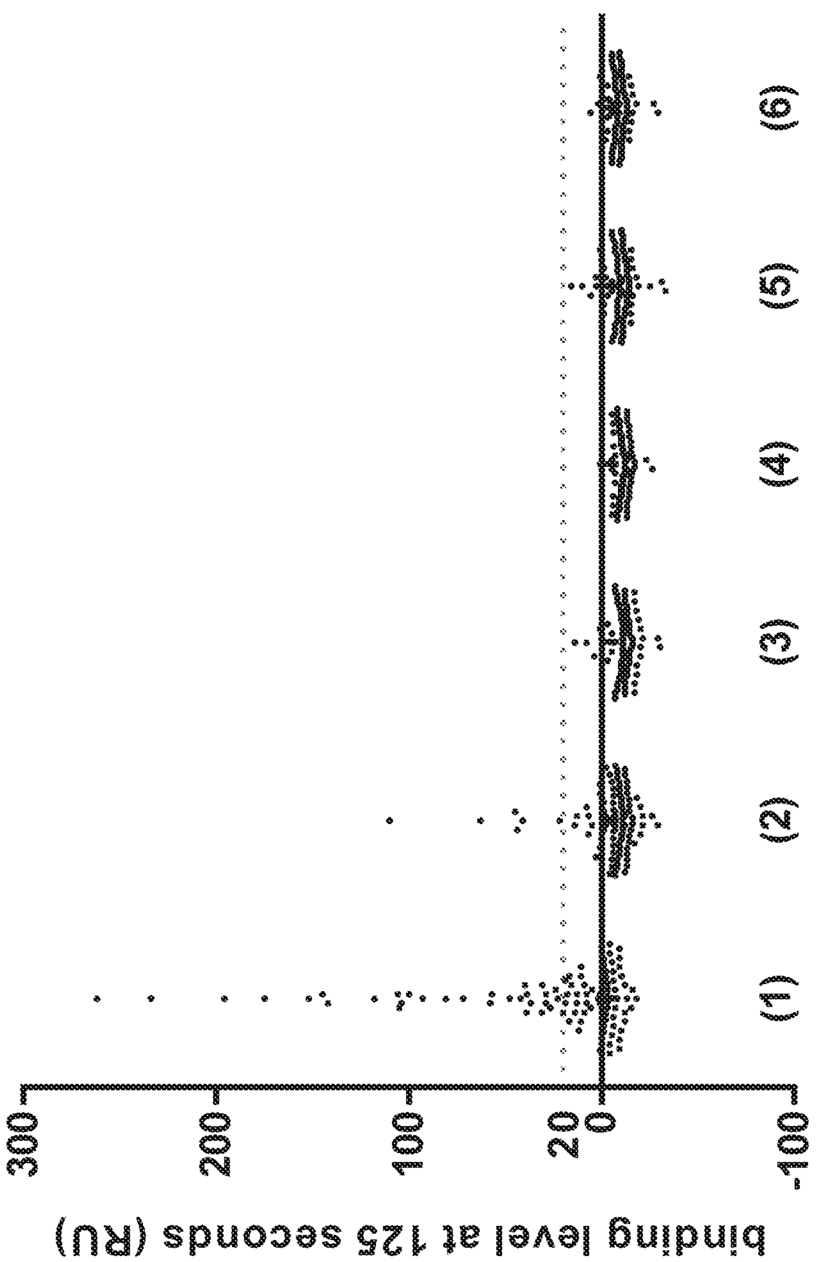
FIG. 8 is a plot showing data points obtained in Example 6 when 98 serum samples obtained from healthy volunteers were tested for binding representative bivalent Nanobody constructs. Each dot represents a data point collected by testing of the indicated construct against one of the 30 serum samples. Legenda: (1)=Reference Y (Nanobody A-35GS-Nanobody B); (2)=Reference Y+C-terminal Ala; (3)=Reference Y+L11V+V89L+C-terminal Ala; (4)=Reference Y+L11V+T87A+V89L+C-terminal Ala; (5)=Reference Y+L11V+V89L+T110K+C-terminal Ala; (6)=Reference Y+L11V+V89L+T110Q+C-terminal Ala.

The representative constructs tested are listed in Tables L (trivalent constructs) and M (bivalent constructs), and the results are shown in FIGS. 6-8 and Tables N-Q. The trivalent constructs tested were derived from the reference construct Nanobody A-35GS-Nanobody A-35GS-Nanobody B ("Reference X") and the bivalent constructs were derived from the reference construct Nanobody A-35GS-Nanobody B ("Reference X"). All of the constructs (except for the reference constructs) had, were indicated, a C-terminal alanine residue as well as, in each of the "Nanobody A" and "Nanobody B" building blocks, the indicated mutations.

TABLE L trivalent constructs tested.

| Trivalent constructs The constructs (except for the reference constructs) had, were indicated, a C-terminal alanine residue as well as, in each of the building blocks, the indicated mutations. | Mutation(s) | | | | | |
|---|---|---|---|---|---|---|
| | L11V | T87A | V89L | T110K | T110Q | 114A |
| Reference X (=Nanobody A-35GS-Nanobody A-35GS-Nanobody B) | | | | | | |
| Reference X + C-terminal Ala | | | | | | x |
| Reference X + L11V + V89L + C-terminal Ala | x | | x | | | x |
| Reference X + L11V + V89L + T110K + C-terminal Ala | x | | x | x | | x |
| Reference X + L11V + T87A + V89L + C-terminal Ala | x | x | x | | | x |
| Reference X + L11V + V89L + T110Q + C-terminal Ala | x | | x | | x | x |

TABLE M bivalent constructs tested.

| Bivalent constructs The constructs (except for the reference constructs) had, were indicated, a C-terminal alanine residue as well as, in each of the building blocks, the indicated mutations. | Mutation(s) | | | | | |
|---|---|---|---|---|---|---|
| | L11V | T87A | V89L | T110K | T110Q | 114A |
| Reference Y (=Nanobody A-35GS-Nanobody B) | | | | | | |
| Reference Y + C-terminal Ala | | | | | | x |
| Reference Y + L11V + V89L + C-terminal Ala | x | | x | | | x |
| Reference Y + L11V + V89L + T110K + C-terminal Ala | x | | x | x | | x |
| Reference Y + L11V + T87A + V89L + C-terminal Ala | x | x | x | | | x |
| Reference Y + L11V + V89L + T110Q + C-terminal Ala | x | | x | | x | x |

TABLE N results of testing trivalent constructs for binding by pre-existing antibodies present in 98 serum samples obtained from healthy human volunteers. Results are also represented in FIG. 6 as a plot in which each dot represents a data point collected by testing of the indicated construct against one of the 98 serum samples.

| Nanobody tested on 98 samples (healthy subjects) | Lane number in the plot shown in FIG. 6 | Binding level at 125 seconds <10 RU | Binding level at 125 seconds <20 RU | Binding level at 125 seconds >20 RU |
|---|---|---|---|---|
| Reference X | (1) | 38 | 48 | 50 |
| Reference X + C-terminal Ala | (2) | 64 | 75 | 23 |

TABLE N-continued results of testing trivalent constructs for binding by pre-existing antibodies present in 98 serum samples obtained from healthy human volunteers. Results are also represented in FIG. 6 as a plot in which each dot represents a data point collected by testing of the indicated construct against one of the 98 serum samples.

| Nanobody tested on 98 samples (healthy subjects) | Lane number in the plot shown in FIG. 6 | Binding level at 125 seconds <10 RU | Binding level at 125 seconds <20 RU | Binding level at 125 seconds >20 RU |
|---|---|---|---|---|
| Reference X + L11V + V89L + C-terminal Ala | (3) | 94 | 95 | 3 |
| Reference X + L11V + V89L + T110K + C-terminal Ala | (5) | 95 | 96 | 2 |
| Reference X + L11V + V89L + T110Q + C-terminal Ala | (6) | 95 | 96 | 2 |
| Reference X + L11V + T87A + V89L + C-terminal Ala | (4) | 92 | 95 | 3 |

TABLE O results of testing trivalent constructs for binding by pre-existing antibodies present in 30 selected serum samples obtained from healthy human volunteers. The 30 samples used were pre-selected for either having a known high titer of pre-existing antibodies or because it was known that the pre-existing antibodies present in the sample still has a high degree of binding even if a C-terminal alanine residue is present. Results are also represented in FIG. 7 as a plot in which each dot represents a data point collected by testing of the indicated construct against one of the selected 30 serum samples.

| Nanobody tested on selected set of 30 samples | Lane number in the plot shown in FIG. 7 | Binding level at 125 seconds <10 RU | Binding level at 125 seconds <20 RU | Binding level at 125 seconds >20 RU |
|---|---|---|---|---|
| Reference X + C-terminal Ala | (1) | 12 | 13 | 17 |
| Reference X + L11V + V89L + C-terminal Ala | (2) | 18 | 22 | 8 |
| Reference X + L11V + T87A + V89L + C-terminal Ala | (3) | 27 | 27 | 3 |
| Reference X + L11V + V89L + T110K + C-terminal Ala | (4) | 26 | 26 | 4 |

TABLE P results of testing bivalent constructs for binding by pre-existing antibodies present in 98 serum samples obtained from healthy human volunteers. Results are also represented in FIG. 8 as a plot in which each dot represents a data point collected by testing of the indicated construct against one of the 98 serum samples.

| Nanobody tested on 98 samples (healthy subjects) | Lane number in the plot shown in FIG. 8 | Binding level at 125 seconds <10 RU | Binding level at 125 seconds <20 RU | Binding level at 125 seconds >20 RU |
|---|---|---|---|---|
| Reference Y | (1) | 54 | 67 | 31 |
| Reference Y + C-terminal Ala | (2) | 90 | 92 | 6 |

TABLE P-continued results of testing bivalent constructs for binding by pre-existing antibodies present in 98 serum samples obtained from healthy human volunteers. Results are also represented in FIG. 8 as a plot in which each dot represents a data point collected by testing of the indicated construct against one of the 98 serum samples.

| Nanobody tested on 98 samples (healthy subjects) | Lane number in the plot shown in FIG. 8 | Binding level at 125 seconds <10 RU | Binding level at 125 seconds <20 RU | Binding level at 125 seconds >20 RU |
|---|---|---|---|---|
| Reference Y + L11V + V89L + C-terminal Ala | (3) | 97 | 98 | 0 |
| Reference Y + L11V + T87A + V89L + C-terminal Ala | (4) | 98 | 98 | 0 |
| Reference Y + L11V + V89L + T110K + C-terminal Ala | (5) | 96 | 98 | 0 |
| Reference Y + L11V + V89L + T110Q + C-terminal Ala | (6) | 98 | 98 | 0 |

Three representative trivalent constructs were also tested against serum samples obtained from SLE patients. The results are shown in Table Q.

TABLE Q testing of representative trivalent constructs against serum samples obtained from HLE patients.

| The constructs (had, were indicated, a C-terminal alanine residue as well as, in each of the building blocks, | Mutation(s) | | | | | | Samples obtained from SLE patients | | | | | Sample from healthy volunteer |
|---|---|---|---|---|---|---|---|---|---|---|---|---|
| the indicated mutations. | L11V | T87A | V89L | T110K | T110Q | 114A | SLE25 | SLE37 | SLE39 | SLE41 | NB13025-14 | 004-030-ABL-02 |
| Average binding to [Reference X + C-terminal Ala] | | | | | | | | | | | | |
| Reference X + C-terminal alanine | | | | | | | 142 | 194 | 126 | 108 | 102 | 27 |
| Inhibition compared to average binding to [Reference X + C-terminal Ala] captured on HSA (%) | | | | | | | | | | | | |
| Reference X + L11V + V89L + C-terminal alanine | x | | x | | | x | 100 | 95 | 100 | 88 | 100 | 0 |
| Reference X + L11V + V89L + T110K + C-terminal alanine | x | | x | x | | x | 100 | 76 | 100 | 100 | 100 | 100 |
| Reference X + L11V + 87A + V89L + C-terminal alanine | x | x | x | | | x | 100 | 100 | 100 | 100 | 97 | 100 |

Example 7: Nanobodies and Nanobody-Constructs Against the Ion Channel Kv1.3

In one specific aspect, the VH domains of the invention (and in particular ISVDs of the invention and more in particular Nanobodies of the invention) and compounds of the invention may be directed against the ion channel Kv.1.3.

The co-pending US provisional application U.S. Ser. No. 62/014,023 (title: “Kv1.3 binding immunoglobulins”; assignee: Ablynx N.V.; filing date: Jun. 18, 2014) as well as the subsequent filed US provisional application of the same title filed on Mar. 16, 2015 (assignee: Ablynx N.V.) inter alia describe immunoglobulin single variable domains (and in particular Nanobodies) that are directed against the potassium selective voltage-gated ion channel Kv1.3, as well as proteins, polypeptides and other Nanobody-based constructs that comprise at least one such Nanobody against Kv1.3.

The mutations described in the present application (optionally suitably combined with a C-terminal extension as described in herein and/or in WO 12/175741) may also be suitably applied to the Nanobodies, proteins, polypeptides and other Nanobody-based constructs against Kv1.3 that are described in these two US provisional applications.

Thus, in one aspect, the invention relates to a VH domain that is directed against Kv1.3 and that is as further described herein for the ISVD’s of the invention (i.e. comprising the amino acid residues/mutations as described herein).

Again, as with other aspects and embodiments of the invention described herein, when a specific ISVD (such as the ISVD against Kv1.3 described in this Example) or compound comprising the same is said to be “according to the invention” or “as further described herein”, the preferred aspects/embodiments and preferences that are generally described herein for the ISVD’s or compounds of the invention also specifically apply to said specific ISVD or compound, respectively, unless explicitly indicated otherwise or unless the specific technical context requires otherwise.

Thus, in a particular aspect, the present invention relates to a VH domain that is directed against Kv1.3, in which (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). In particular, in such VH domains against Kv1.3:

- the amino acid residue at position 11 is preferably chosen from L, V or K (and is most preferably V); and
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v).

The VH domains against Kv1.3 referred to in this Example may in particular have CDR's that are as described on pages 5-10 of U.S. Ser. No. 62/014,023 (including any preferred aspects/embodiments of such CDRs) or sequence-optimized versions thereof, as described in the other US provisional application referred to above.

In particular, the VH domains against Kv 1.3 referred to in this Example may in particular have a combination of CDR1, CDR2 and CDR3 that is chosen from one of the combination of CDR 1, CDR2 and CDR3 that are listed as preferred aspects in the list that bridges pages 9 and 10 of U.S. Ser. No. 62/014,023.

In some preferred, but non-limiting aspect of the inventions:

- in a VH domain of the invention: (i) CDR1 (according to Kabat) is the sequence of SED ID NO:166 or an amino acid sequence that has one or two amino acid differences with the sequence of SEQ ID NO:166; (ii) CDR2 (according to Kabat) is the sequence of SED ID NO:167 or an amino acid sequence that has one or two amino acid differences with the sequence of SEQ ID NO:167; and (iii) CDR3 (according to Kabat) is the sequence of SED ID NO:168 or an amino acid sequence that has one or two amino acid differences with the sequence of SEQ ID NO:168; and even more preferably: (i) CDR1 (according to Kabat) is the sequence of SED ID NO:166; (ii) CDR2 (according to Kabat) is the sequence of SED ID NO:167; and (iii) CDR3 (according to Kabat) is the sequence of SED ID NO:168; and/or
- in a VH domain of the invention: (i) CDR1 (according to Abm) is the sequence of SED ID NO:169 or an amino acid sequence that has one or two amino acid differences with the sequence of SEQ ID NO:169; (ii) CDR2 (according to Abm) is the sequence of SED ID NO:170 or an amino acid sequence that has one or two amino acid differences with the sequence of SEQ ID NO:170; and (iii) CDR3 (according to Abm) is the sequence of SED ID NO:171 or an amino acid sequence that has one or two amino acid differences with the sequence of SEQ ID NO:171; and even more preferably: (i) CDR1 (according to Abm) is the sequence of SED ID NO:169; (ii) CDR2 (according to Abm) is the sequence of SED ID NO:170; and (iii) CDR3 (according to Abm) is the sequence of SED ID NO:178.

The VH domains of the invention against Kv1.3 may further be as described herein and may again in particular be an ISVD (and more in particular a Nanobody) against Kv1.3 or a protein, polypeptide or other compound or construct that comprises as least one such ISVD. Such a protein, polypeptide or other compound or construct may also be as further described herein, and may for example have an increased half-life (i.e. as described herein, e.g. a half-life—expressed as t1/2 beta—in human subjects of in human subjects of at least 1 day, preferably at least 3 days, more preferably at least 7 days, such as at least 10 days), and for this purpose may for example comprise a serum-albumin binding Nanobody, which may also be a serum-albumin binding Nanobody of the invention (again, as described herein).

Also, such an ISVD may suitably have a C-terminal extension (as further described herein and in WO 12/175741), in particular when said ISVD forms the C-terminal end of a protein, polypeptide or other compound or construct comprising the same (again, as further described herein).

For example and without limitation, the VH domains of the invention against Kv1.3 may be one of the sequences listed in Table A-1 of U.S. Ser. No. 62/014,023 (SEQ ID NO's: 1 to 123 in U.S. Ser. No. 62/014,023) or one of the sequences of listed in Table A-1 of US provisional application entitled "Kv1.3 binding immunoglobulins" (assignee: Ablynx N.V.; filing date: Mar. 16, 2015) (SEQ ID NO's: 1 to 123, 495, 498 to 513 or 523 to 540 in said US provisional; and in particular the sequence of SEQ ID NO: 495), but suitably with the mutations/specific amino acid residues described herein for the ISVDs of the invention, and optionally suitably with a C-terminal extension.

In one specific aspect, a Nanobody of the invention against Kv1.3 is a variant of the Nanobody of SEQ ID NO:137 (with at least 90% sequence identity with SEQ ID NO:137), in which:

- the amino acid residue at position 11 is preferably chosen from L, V or K (and is most preferably V); and
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v).

Some specifically preferred, but non-limiting examples of Nanobodies of the invention against Kv1.3 and of compounds of the invention comprising the same are listed in FIG. 9A (monovalent Nanobodies: SEQ ID NO's: 138 to 155) and FIG. 9B (trivalent bispecific half-life extended constructs: SEQ ID NO's: 156 to 164). Compounds of the invention that comprise or essentially consist of at least one (such as one, two or three) anti-Kv1.3 Nanobody chosen from the anti-Kv1.3 Nanobodies of SEQ ID NO's: 138 to 155 form a further aspect of the invention. Also, each of the compounds of SEQ ID NO's: 156 to 164 forms a further aspect of the invention. In one specific aspect, such compounds contain two such Nanobodies of the invention against Kv1.3 and one Nanobody against human serum albumin (which is preferably also a Nanobody of the invention). Also, again, such a construct may contain suitable linkers and a C-terminal extension.

The monovalent anti-Kv1.3 Nanobodies of SEQ ID NO's: 138 to 155 were generated by introducing the L11V and V89L mutations of the invention into the starting sequence of SEQ ID NO: 137 (reference). In addition, different combinations of humanizing (or other sequence-optimizing) mutations were introduced, such as E1D, A14P, G19R, M53A or M53Q or M53Y, T62S, A74S, K83R, S94G and/or T97E). The specific mutations introduced in each of the sequences of SEQ ID NO: 138 to 155 is given in FIG. 9A.

Figure 10:
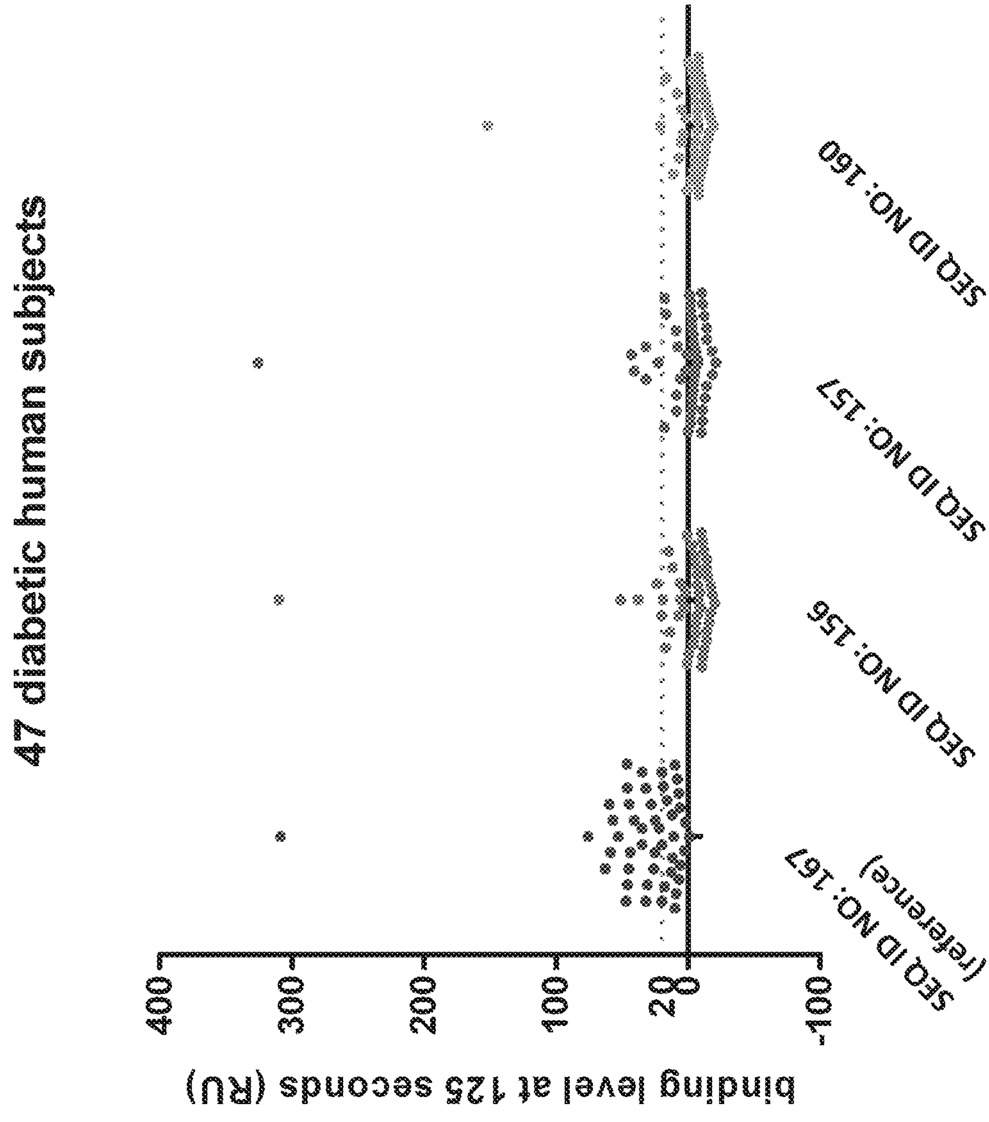
FIG. 10 is a plot showing data points obtained in Example 7 when 47 serum samples obtained from diabetic human subjects were tested for binding representative trivalent bispecific half-life extended compounds of the invention against Kv1.3. Each dot represents a data point collected by testing of the indicated construct against one of the 47 serum samples. The SEQ ID NO's refer to the relevant sequences listed in FIG. 9.
Figure 11:
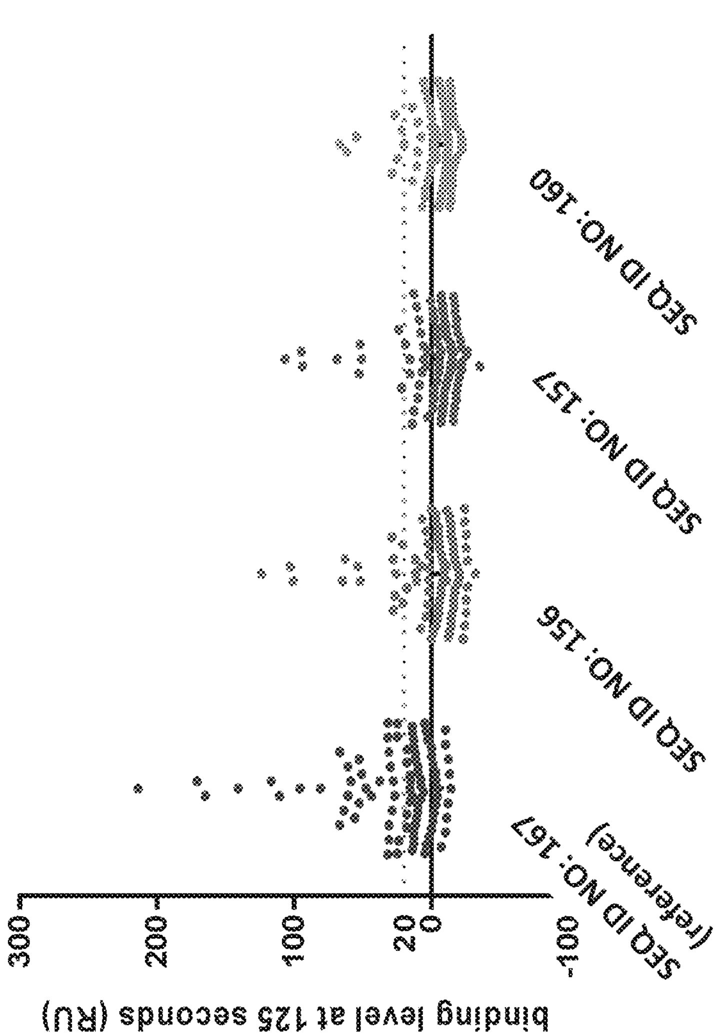
FIG. 11 is a plot showing data points obtained in Example 7 when 90 serum samples obtained from healthy volunteers were tested for binding representative trivalent bispecific half-life extended compounds of the invention against Kv1.3. Each dot represents a data point collected by testing of the indicated construct against one of the 47 serum samples. The SEQ ID NO's refer to the relevant sequences listed in FIG. 9.

Some of the monovalent anti-Kv1.3 Nanobodies from FIG. 9A were also formatted as trivalent bispecific constructs comprising two Nanobodies of the invention against Kv1.3 and one half-life extending Nanobody of the invention against human serum albumin (SEQ ID NO:109, also referred to as "ALB-82" in FIG. 9B). 35GS linkers were used, and all the constructs have a C-terminal extension (a single C-terminal alanine residue). The sequences of the resulting constructs are given in SEQ ID NO's 156 to 164. Of these, three constructs (SEQ ID NOs: 156, 157 and 160) were tested for binding by pre-existing antibodies in samples obtained from 47 diabetic human subjects and 90 healthy human subjects, using the general protocol described herein. The binding by pre-existing antibodies by samples from these two sets were compared to the reference construct of SEQ ID NO:165, which is a corresponding trivalent bispecific construct based on the reference anti-Kv1.3 building block of SEQ ID NO:137 and the serum albumin binder Alb-8 (SEQ ID NO:46), again combined with a C-terminal alanine extension. The results are shown in FIG. 10 (samples from 47 diabetic patients) and FIG. 11 (samples from 90 healthy volunteers). In each case, the constructs with the L11V and V89L mutations of the invention showed reduced binding by pre-existing antibodies compared to the reference construct.

Example 8: VH Domains (and in Particular Nanobodies) Against IL-23, and Compounds of the Invention Comprising the Same In one specific aspect, the VH domains of the invention (and in particular ISVDs of the invention and more in particular Nanobodies of the invention) and compounds of the invention may be directed against IL-23.

Such a VH domain of the invention against IL-23 will generally comprise: (i) suitable framework sequences that suitably comprise the amino acid residues/mutations of the invention as described herein; as well as (ii) CDR sequences that allow the VH domain of the invention to specifically bind to IL-23. In addition, such a VH domain of the invention against IL-23 may also suitably have a C-terminal extension as described herein, in particular when said VH domain is monovalent or forms the C-terminal end of the compound of the invention in which said VH domain is present (again, as further described herein). Such VH domains of the invention against IL-23 may further be as further described herein, and may in particular be ISVD's.

Again, as with other aspects and embodiments of the invention described herein, when a specific ISVD (such as the ISVD against IL-23 described in this Example) or compound comprising the same is said to be "according to the invention" or "as further described herein", the preferred aspects/embodiments and preferences that are generally described herein for the ISVD's or compounds of the invention also specifically apply to said specific ISVD or compound, respectively, unless explicitly indicated otherwise or unless the specific technical context requires otherwise.

Thus, in a particular aspect, the present invention relates to a VH domain (and in particular an ISVD) that is directed against IL-23, in which (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). In particular, in such VH domains against IL-23:

- the amino acid residue at position 11 is preferably chosen from L, V or K (and is most preferably V); and
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v).

The VH domains of the invention against IL-23 may further be as described herein and may again in particular be an ISVD (and more in particular a Nanobody) against IL-23 or a protein, polypeptide or other compound or construct that comprises as least one such ISVD. Such a protein, polypeptide or other compound or construct may also be as further described herein, and may for example have an increased half-life (i.e. as described herein, e.g. a half-life—expressed as t1/2 beta—in human subjects of in human subjects of at least 1 day, preferably at least 3 days, more preferably at least 7 days, such as at least 10 days), and for this purpose may for example comprise a serum-albumin binding Nanobody, which may also be a serum-albumin binding Nanobody of the invention (again, as described herein).

Also, such an ISVD may suitably have a C-terminal extension (as further described herein and in WO 12/175741), in particular when said ISVD forms the C-terminal end of a protein, polypeptide or other compound or construct comprising the same (again, as further described herein).

In one preferred aspect, the VH domains of the invention against IL-23 comprise (i) a CDR1 sequence that is the sequence of SEQ ID NO: 173 (which is preferred) or that is an amino acid sequence that has only one amino acid difference with the sequence of SEQ ID NO: 173; (ii) a CDR2 sequence that is the sequence of SEQ ID NO: 174 (which is preferred) or that is an amino acid sequence that has only one or two amino acid differences with the sequence of SEQ ID NO: 174; and (iii) a CDR3 sequence that is the sequence of SEQ ID NO: 175 (which is preferred)

or that is an amino acid sequence that has only one or two amino acid differences with the sequence of SEQ ID NO: 175.

More preferably, in a VH domain of the invention against IL-23 according to this aspect: (i) CDR1 is SEQ ID NO:173; (ii) CDR2 is SEQ ID NO: 174; and (iii) CDR3 is SEQ ID NO: 175.

In one specific aspect, a Nanobody of the invention against IL-23 is a variant of the Nanobody of SEQ ID NO:172 (with at least 90% sequence identity, such as at least 95% sequence identity, with SEQ ID NO:172), in which:

- the amino acid residue at position 11 is preferably chosen from L, V or K (and is most preferably V); and
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). The CDR's of such an ISV are preferably as defined in the preceding two paragraphs.

In another preferred aspect, the VH domains of the invention against IL-23 comprise (i) a CDR1 sequence that is the sequence of SEQ ID NO: 191 (which is preferred) or that is an amino acid sequence that has only one amino acid difference with the sequence of SEQ ID NO: 191; (ii) a CDR2 sequence that is the sequence of SEQ ID NO: 192 (which is preferred) or that is an amino acid sequence that has only one or two amino acid differences with the sequence of SEQ ID NO: 192; and (iii) a CDR3 sequence that is the sequence of SEQ ID NO: 193 (which is preferred) or that is an amino acid sequence that has only one or two amino acid differences with the sequence of SEQ ID NO: 193.

More preferably, in a VH domain of the invention against IL-23 according to this aspect: (i) CDR1 is SEQ ID NO: 191; (ii) CDR2 is SEQ ID NO: 192; and (iii) CDR3 is SEQ ID NO: 193.

In one specific aspect, a Nanobody of the invention against IL-23 is a variant of the Nanobody of SEQ ID NO:172 (with at least 90% sequence identity, such as at least 95% sequence identity, with SEQ ID NO:190), in which:

- the amino acid residue at position 11 is preferably chosen from L, V or K (and is most preferably V); and
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). Again, the CDR's of such an ISV are preferably as defined in the preceding two paragraphs.

Some specifically preferred, but non-limiting examples of such Nanobodies of the invention against IL-23 are listed in FIG. 12A as SEQ ID NO's: 176 to 189 and FIG. 12B as SEQ ID NO's: 194 to 207, respectively; and each of these Nanobodies form a further aspect of the invention.

The invention also relates to a compound of the invention against IL-23 that comprises at least one (such as one, two or three) of the Nanobodies of the invention of SEQ ID NO's: 176 to 189 and/or 194 to 207. Such compounds of the invention against IL-23 may again be as further described herein, and thus for example may comprise suitable linkers, may comprise a C-terminal extension as described herein, and may be half-life extended (for example because they comprise a Nanobody against human serum albumin, such as (preferably) a Nanobody of the invention against human serum albumin). Reference is made to Table R below.

As described in for example WO 2009/068627, WO 2010/142534 and WO2011/135026, on particularly preferred class of Nanobody-based compounds against IL-23 are biparatopic compounds. Thus, in one aspect of the invention, a compound of the invention against IL-23 is a biparatopic construct that comprises one ISV that is either SEQ ID NO: 172 or (preferably) an ISV of the invention that has been derived from SEQ ID NO:172 (as described in this Example 8) and one ISV that is either SEQ ID NO: 190 or (preferably) an ISV of the invention that has been derived from SEQ ID NO: 190 (as described in this Example 8), provided that at least one (and preferably both) of these ISV's are ISV's of the invention. Such biparatopic constructs may also be half-life extended (i.e. by means of a serum albumin-binding ISV). Some specific examples of such biparatopic constructs are given in SEQ ID NO: 514 to 549.

Some specifically preferred examples of compounds of the invention against IL-23 are given in FIG. 22 as SEQ ID NO's: 514 to 549; and each of these compounds form a further aspect of the invention. Thus, in another aspect, the invention relates to a polypeptide that is directed against IL-23 and that has an amino acid sequence that is chosen from the group consisting of SEQ ID NO's: 514 to 549. More generally, compounds of the invention against IL-23 may be as described in WO 2009/068627, WO 2010/142534 and WO2011/135026, but comprising ISV's of the invention. They may also be used for the purposes described in WO 2009/068627, WO 2010/142534 and WO2011/135026.

TABLE R

Examples of compounds of the invention against IL-23.

| Polypeptide/ construct([1]) | General formula | ISV building blocks and linkers |
|---|---|---|
| Monovalent | [IL-23] | [IL-23] = one of SEQ ID NO's: 464 to 477 and/or 482 to 495 |
| Monovalent/ C-terminal extension | [IL-23]-X(n) | [IL-23] = one of SEQ ID NO's: 464 to 477 and/or 482 to 495 |
| Monovalent/ half-life extended | [IL-23]-$L_1$-[SA]<br>[SA]-$L_1$-[IL-23] | [IL-23] = one of SEQ ID NO's: 464 to 477 and/or 482 to 495<br>[SA] = (see legend below)<br>$L_1$ = (see legend below) |
| Monovalent/ half-life extended/ C-terminal extension | [IL-23]-$L_1$-[SA]-X(n)<br>[SA]-$L_1$-[IL-23]-X(n) | [IL-23] = one of SEQ ID NO's: 464 to 477 and/or 482 to 495<br>[SA] = (see legend below)<br>$L_1$ = (see legend below)<br>X(n) = (see legend below) |
| Bivalent([2]) | [IL-23]-$L_1$-[IL-23] | At least one [IL-23] present is = one of SEQ ID NO's: 464 to 477 and/or 482 to 495 ([4])<br>$L_1$ = (see legend below) |
| Bivalent/ C-terminal extension([2]) | [IL-23]-$L_1$-[IL-23]-X(n) | At least one [IL-23] = one of SEQ ID NO's: 464 to 477 and/or 482 to 495 ([4])<br>$L_1$ = (see legend below)<br>X(n) = (see legend below) |
| Bivalent/ half-life extended([2]) | [IL-23]-$L_1$-[IL-23]-$L_2$-[SA]<br>[IL-23]-$L_1$-[SA]-$L_2$-[IL-23]<br>[SA]-$L_1$-[IL-23]-$L_2$-[IL-23] | At least one [IL-23] present is = one of SEQ ID NO's: 464 to 477 and/or 482 to 495 ([4])<br>[SA] = (see legend below)<br>$L_1$ = (see legend below)<br>$L_2$ = (see legend below) |
| Bivalent/ half-life extended/ C-terminal extension([2]) | [IL-23]-$L_1$-[IL-23]-$L_2$-[SA]-X(n)<br>[IL-23]-$L_1$-[SA]-$L_2$-[IL-23]-X(n)<br>[SA]-$L_1$-[IL-23]-$L_2$-[IL-23]-X(n) | At least one [IL-23] present is = one of SEQ ID NO's: 464 to 477 and/or 482 to 495 ([4])<br>[SA] = (see legend below)<br>$L_1$ = (see legend below)<br>$L_2$ = (see legend below)<br>X(n) = (see legend below) |
| Bispecific ([3]) | [IL-23]-$L_1$-[Nb]<br>[Nb]-$L_1$-[IL-23]<br>[IL-23]-$L_1$-[IL-23]-$L_2$-[Nb]<br>[IL-23]-$L_1$-[Nb]-$L_2$-[IL-23]<br>[Nb]-$L_1$-[IL-23]-$L_2$-[IL-23] | At least one [IL-23] present is = one of SEQ ID NO's: 464 to 477 and/or 482 to 495 ([4])<br>$L_1$ = (see legend below)<br>$L_2$ = (see legend below)<br>[Nb] = (see legend below) |
| Bispecific/ C-terminal extension ([3]) | [IL-23]-$L_1$-[Nb]-X(n)<br>[Nb]-$L_1$-[IL-23]-X(n)<br>[IL-23]-$L_1$-[IL-23]-$L_2$-[Nb]-X(n)<br>[IL-23]-$L_1$-[Nb]-$L_2$-[IL-23]-X(n)<br>[Nb]-$L_1$-[IL-23]-$L_2$-[IL-23]-X(n) | At least one [IL-23] present is = one of SEQ ID NO's: 464 to 477 and/or 482 to 495 ([4])<br>$L_1$ = (see legend below)<br>$L_2$ = (see legend below)<br>X(n) = (see legend below)<br>[Nb] = (see legend below) |
| Bispecific/ half-life extended ([3]) | [IL-23]-$L_1$-[Nb]-$L_2$-[SA]<br>[IL-23]-$L_1$-[SA]-$L_2$-[Nb]<br>[Nb]-$L_1$-[SA]-$L_2$-[IL-23]<br>[Nb]-$L_1$-[IL-23]-$L_2$-[SA]<br>[SA]-$L_1$-[IL-23]-$L_2$-[Nb]<br>[SA]-$L_1$-[Nb]-$L_2$-[IL-23] | At least one [IL-23] present is = one of SEQ ID NO's: 464 to 477 and/or 482 to 495 ([4])<br>[SA] = (see legend below)<br>$L_1$, $L_2$, $L_3$(see legend below)<br>[Nb] = (see legend below) |
| Bispecific/ half-life extended ([3]) | [IL-23]-$L_1$-[IL-23]-$L_2$-[Nb]-$L_3$-[SA]<br>[Nb]-$L_1$-[IL-23]-$L_2$-[IL-23]-$L_3$-[SA]<br>[SA]-$L_1$-[IL-23]-$L_2$-[IL-23]-$L_3$-[Nb]<br>[SA]-$L_1$-[IL-23]-$L_2$-[Nb]-$L_3$-[IL-23]<br>[IL-23]-$L_1$-[Nb]-$L_2$-[IL-23]-$L_3$-[SA] | At least one [IL-23] present is = one of SEQ ID NO's: 464 to 477 and/or 482 to 495 ([4])<br>[SA] = (see legend below)<br>$L_1$, $L_2$, $L_3$(see legend below)<br>[Nb] = (see legend below) |

TABLE R-continued

Examples of compounds of the invention against IL-23.

| Polypeptide/ construct(1) | General formula | ISV building blocks and linkers |
|---|---|---|
| Bispecific/ half-life extended/ C-terminal extension (3) | [IL-23]-$L_1$-[Nb]-$L_2$-[SA]-X(n)<br>[IL-23]-$L_1$-[SA]-$L_2$-[Nb]-X(n)<br>[Nb]-$L_1$-[SA]-$L_2$-[IL-23]-X(n)<br>[Nb]-$L_1$-[IL-23]-$L_2$-[SA]-X(n)<br>[SA]-$L_1$-[IL-23]-$L_2$-[Nb]-X(n)<br>[SA]-$L_1$-[Nb]-$L_2$-[IL-23]-X(n)<br>[IL-23]-$L_1$-[IL-23]-$L_2$-[Nb]-$L_3$-[SA]-X(n)<br>[Nb]-$L_1$-[IL-23]-$L_2$-[IL-23]-$L_3$-[SA]-X(n)<br>[SA]-$L_1$-[IL-23]-$L_2$-[IL-23]-$L_3$-[Nb]-X(n)<br>[SA]-$L_1$-[IL-23]-$L_2$-[Nb]-$L_3$-[IL-23]-X(n)<br>[IL-23]-$L_1$-[Nb]-$L_2$-[IL-23]-$L_3$-[SA]-X(n) | At least one [IL-23] present is = one of SEQ ID NO's: 464 to 477 and/or 482 to 495 (4)<br>[SA] = (see legend below)<br>$L_1$, $L_2$, $L_3$(see legend below)<br>X(n) = (see legend below)<br>[Nb] = (see legend below) |

Legend:

[SA] is an ISV against (human) serum albumin, preferably an ISV of the invention against (human) serum albumin, more preferably one of SEQ ID NO's: 46 or 61 or even more preferably one of the ISVD's of the invention of SEQ ID NO's: 47, 54, 62, 69, 78, 86, 109, 116, 123, 130 or 496 to 513.

Each of $L_1$, $L_2$ and $L_3$ is (independently) a suitable linker. Each of $L_1$, $L_2$ and $L_3$ may (independently) be present or not. Non-limiting examples of suitable linkers are the gly-ser linkers referred to herein, such as the 9GS, 30GS or 35GS linker.

X(n) = a C-terminal extension as a C-terminal extension as described in herein and/or in WO 12/175741

[Nb] is an ISV against another therapeutic target.

Notes:

(1)In this Table:

"Monovalent" generally refers to polypeptides/constructs comprising a single ISV against IL-23. These may further comprise a half-life extending ISV (such as an ISV against serum albumin).

"Bivalent" generally refers to polypeptides/constructs comprising two ISV's against IL-23 (which may be the same or different). These may again further comprise a half-life extending ISV (such as an ISV against serum albumin).

"Bispecific" generally refers to polypeptides/constructs comprising at least one (such as 1 or 2) ISV's against IL-23 and at least one (such as 1 or 2) other ISV against a therapeutic target. These may further comprise a half-life extending ISV (such as an ISV against serum albumin).

In the polypeptides/constructs described in this table, at least one of the ISV's against IL-23 present is an ISV of the invention, and preferably all of the ISV's against IL-23 present in such polypeptide/construct are ISV's of the invention. Also, when a half-life extending ISV and/or an ISV against another therapeutic target is present in such polypeptide/construct, each of these (and preferably all of these) may also be (and preferably are) ISV's of the invention (2)All "bivalent" constructs in this Table may also be biparatopic, meaning that they comprise at least two (such as two) ISV's against IL-23, which are directed against different epitopes on IL-23.

(3) As will be clear to the skilled person, other/further bispecific constructs than those listed can be made using the building blocks and linkers mentioned.

(4) Preferably, each [IL-23] present is independently chosen from SEQ ID NO's: 464 to 477 and/or 482 to 495. Also, the [IL-23] present may be the same or different; in a biparatopic polypeptide/construct they will be directed against different epitopes on IL-23.

(5) Each of the polypeptides/constructs mentioned to in this column by means of reference to a SEQ ID forms an individual specific aspect of the invention.

Example 9: VH Domains (and in Particular Nanobodies) Against OX40-L, and Compounds of the Invention Comprising the Same In one specific aspect, the VH domains of the invention (and in particular ISVDs of the invention and more in particular Nanobodies of the invention) and compounds of the invention may be directed against OX40-L.

Such a VH domain of the invention against OX40-L will generally comprise: (i) suitable framework sequences that suitably comprise the amino acid residues/mutations of the invention as described herein; as well as (ii) CDR sequences that allow the VH domain of the invention to specifically bind to OX40-L. In addition, such a VH domain of the invention against OX40-L may also suitably have a C-terminal extension as described herein, in particular when said VH domain is monovalent or forms the C-terminal end of the compound of the invention in which said VH domain is present (again, as further described herein). Such VH domains of the invention against OX40-L may further be as further described herein, and may in particular be ISVD's.

Again, as with other aspects and embodiments of the invention described herein, when a specific ISVD (such as the ISVD against OX40-L described in this Example) or compound comprising the same is said to be "according to the invention" or "as further described herein", the preferred aspects/embodiments and preferences that are generally described herein for the ISVD's or compounds of the invention also specifically apply to said specific ISVD or compound, respectively, unless explicitly indicated otherwise or unless the specific technical context requires otherwise.

Thus, in a particular aspect, the present invention relates to a VH domain (and in particular an ISVD) that is directed against OX40-L, in which (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). In particular, in such VH domains against OX40-L:

- the amino acid residue at position 11 is preferably chosen from L, V or K (and is most preferably V); and
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v).

The VH domains of the invention against OX40-L may further be as described herein and may again in particular be an ISVD (and more in particular a Nanobody) against OX40-L or a protein, polypeptide or other compound or construct that comprises as least one such ISVD. Such a protein, polypeptide or other compound or construct may also be as further described herein, and may for example have an increased half-life (i.e. as described herein, e.g. a half-life—expressed as t1/2 beta—in human subjects of in human subjects of at least 1 day, preferably at least 3 days, more preferably at least 7 days, such as at least 10 days), and for this purpose may for example comprise a serum-albumin binding Nanobody, which may also be a serum-albumin binding Nanobody of the invention (again, as described herein).

Also, such an ISVD may suitably have a C-terminal extension (as further described herein and in WO 12/175741), in particular when said ISVD forms the C-terminal end of a protein, polypeptide or other compound or construct comprising the same (again, as further described herein).

In one preferred aspect, the VH domains of the invention against OX40-L comprise (i) a CDR1 sequence that is the sequence of SEQ ID NO: 209 (which is preferred) or that is an amino acid sequence that has only one amino acid difference with the sequence of SEQ ID NO: 209; (ii) a CDR2 sequence that is the sequence of SEQ ID NO: 210 (which is preferred) or that is an amino acid sequence that has only one or two amino acid differences with the sequence of SEQ ID NO: 210; and (iii) a CDR3 sequence that is the sequence of SEQ ID NO: 211 (which is preferred) or that is an amino acid sequence that has only one or two amino acid differences with the sequence of SEQ ID NO: 211.

More preferably, in a VH domain of the invention against OX40-L according to this aspect: (i) CDR1 is SEQ ID NO:209; (ii) CDR2 is SEQ ID NO: 210; and (iii) CDR3 is SEQ ID NO: 211.

In one specific aspect, a Nanobody of the invention against OX40-L is a variant of the Nanobody of SEQ ID NO:208 (with at least 90% sequence identity, such as at least 95% sequence identity, with SEQ ID NO:208), in which:

- the amino acid residue at position 11 is preferably chosen from L, V or K (and is most
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). The CDR's of such an ISV are preferably as defined in the preceding two paragraphs.

Some specifically preferred, but non-limiting examples of Nanobodies of the invention against OX40-L are listed in FIG. 13 as SEQ ID NO's: 212 to 225; and each of these Nanobodies form a further aspect of the invention.

The invention also relates to a compound of the invention against OX40-L that comprises at least one (such as one, two or three) of the Nanobodies of the invention of SEQ ID NO's: 212 to 225. Such compounds of the invention against OX40-L may again be as further described herein, and thus for example may comprise suitable linkers, may comprise a C-terminal extension as described herein, and may be half-life extended (for example because they comprise a Nanobody against human serum albumin, such as (preferably) a Nanobody of the invention against human serum albumin). Reference is made to Table S below.

Some specifically preferred examples of compounds of the invention against OX40-L are given in FIG. 23 as SEQ ID NO's: 550 to 585; and each of these compounds form a further aspect of the invention. Thus, in another aspect, the invention relates to a polypeptide that is directed against OX40-L and that has an amino acid sequence that is chosen from the group consisting of SEQ ID NO's: 550 to 585. More generally, compounds of the invention against OX40-L may be as described in WO 2011/073180, but comprising ISV's of the invention. They may also be used for the purposes described in WO 2011/073180.

TABLE S

Examples of compounds of the invention against OX40-L.

| Polypeptide/ construct(1) | General formula | ISV building blocks and linkers |
|---|---|---|
| Monovalent | [OX40-L] | [OX40-L] = one of SEQ ID NO's: 464 to 477 and/or 482 to 495 |
| Monovalent/ C-terminal extension | [OX40-L]-X(n) | [OX40-L] = one of SEQ ID NO's: 464 to 477 and/or 482 to 495 |
| Monovalent/ half-life extended | [OX40-L]-$L_1$-[SA]<br>[SA]-$L_1$-[OX40-L] | [OX40-L] = one of SEQ ID NO's: 464 to 477 and/or 482 to 495<br>[SA] = (see legend below)<br>$L_1$ = (see legend below) |
| Monovalent/ half-life extended/ C-terminal extension | [OX40-L]-$L_1$-[SA]-X(n)<br>[SA]-$L_1$-[OX40-L]-X(n) | [OX40-L] = one of SEQ ID NO's: 464 to 477 and/or 482 to 495<br>[SA] = (see legend below)<br>$L_1$ = (see legend below)<br>X(n) = (see legend below) |
| Bivalent(2) | [OX40-L]-$L_1$-[OX40-L] | At least one [OX40-L] present is = one of SEQ ID NO's: 464 to 477 and/or 482 to 495 (4)<br>$L_1$ = (see legend below) |
| Bivalent/ C-terminal extension(2) | [OX40-L]-$L_1$-[OX40-L]-X(n) | At least one [OX40-L] = one of SEQ ID NO's: 464 to 477 and/or 482 to 495 (4)<br>$L_1$ = (see legend below)<br>X(n) = (see legend below) |

TABLE S-continued

Examples of compounds of the invention against OX40-L.

| Polypeptide/ construct(1) | General formula | ISV building blocks and linkers |
|---|---|---|
| Bivalent/ half-life extended(2) | [OX40-L]-$L_1$-[OX40-L]-$L_2$-[SA]<br>[OX40-L]-$L_1$-[SA]-$L_2$-[OX40-L]<br>[SA]-$L_1$-[OX40-L]-$L_2$-[OX40-L] | At least one [OX40-L] present is = one of SEQ ID NO's: 464 to 477 and/or 482 to 495 (4)<br>[SA] = (see legend below)<br>$L_1$ = (see legend below)<br>$L_2$ = (see legend below) |
| Bivalent/ half-life extended/ C-terminal extension(2) | [OX40-L]-$L_1$-[OX40-L]-$L_2$-[SA]-X(n)<br>[OX40-L]-$L_1$-[SA]-$L_2$-[OX40-L]-X(n)<br>[SA]-$L_1$-[OX40-L]-$L_2$-[OX40-L]-X(n) | At least one [OX40-L] present is = one of SEQ ID NO's: 464 to 477 and/or 482 to 495 (4)<br>[SA] = (see legend below)<br>$L_1$ = (see legend below)<br>$L_2$ = (see legend below)<br>X(n) = (see legend below) |
| Bispecific (3) | [OX40-L]-$L_1$-[Nb]<br>[Nb]-$L_1$-[OX40-L]<br>[OX40-L]-$L_1$-[OX40-L]-$L_2$-[Nb]<br>[OX40-L]-$L_1$-[Nb]-$L_2$-[OX40-L]<br>[Nb]-$L_1$-[OX40-L]-$L_2$-[OX40-L] | At least one [OX40-L] present is = one of SEQ ID NO's: 464 to 477 and/or 482 to 495 (4)<br>$L_1$ = (see legend below)<br>$L_2$ = (see legend below)<br>[Nb] = (see legend below) |
| Bispecific/ C-terminal extension (3) | [OX40-L]-$L_1$-[Nb]-X(n)<br>[Nb]-$L_1$-[OX40-L]-X(n)<br>[OX40-L]-$L_1$-[OX40-L]-$L_2$-[Nb]-X(n)<br>[OX40-L]-$L_1$-[Nb]-$L_2$-[OX40-L]-X(n)<br>[Nb]-$L_1$-[OX40-L]-$L_2$-[OX40-L]-X(n) | At least one [OX40-L] present is = one of SEQ ID NO's: 464 to 477 and/or 482 to 495 (4)<br>$L_1$ = (see legend below)<br>$L_2$ = (see legend below)<br>X(n) = (see legend below)<br>[Nb] = (see legend below) |
| Bispecific/ half-life extended (3) | [OX40-L]-$L_1$-[Nb]-$L_2$-[SA]<br>[OX40-L]-$L_1$-[SA]-$L_2$-[Nb]<br>[Nb]-$L_1$-[SA]-$L_2$-[OX40-L]<br>[Nb]-$L_1$-[OX40-L]-$L_2$-[SA]<br>[SA]-$L_1$-[OX40-L]-$L_2$-[Nb]<br>[SA]-$L_1$-[Nb]-$L_2$-[OX40-L] | At least one [OX40-L] present is = one of SEQ ID NO's: 464 to 477 and/or 482 to 495 (4)<br>[SA] = (see legend below)<br>$L_1$, $L_2$, $L_3$(see legend below)<br>[Nb] = (see legend below) |
| Bispecific/ half-life extended (3) | [OX40-L]-$L_1$-[OX40-L]-$L_2$-[Nb]-$L_3$-[SA]<br>[Nb]-$L_1$-[OX40-L]-$L_2$-[OX40-L]-$L_3$-[SA]<br>[SA]-$L_1$-[OX40-L]-$L_2$-[OX40-L]-$L_3$-[Nb]<br>[SA]-$L_1$-[OX40-L]-$L_2$-[Nb]-$L_3$-[OX40-L]<br>[OX40-L]-$L_1$-[Nb]-$L_2$-[OX40-L]-$L_3$-[SA] | At least one [OX40-L] present is = one of SEQ ID NO's: 464 to 477 and/or 482 to 495 (4)<br>[SA] = (see legend below)<br>$L_1$, $L_2$, $L_3$(see legend below)<br>[Nb] = (see legend below) |
| Bispecific/ half-life extended/ C-terminal extension (3) | [OX40-L]-$L_1$-[Nb]-$L_2$-[SA]-X(n)<br>[OX40-L]-$L_1$-[SA]-$L_2$-[Nb]-X(n)<br>[Nb]-$L_1$-[SA]-$L_2$-[OX40-L]-X(n)<br>[Nb]-$L_1$-[OX40-L]-$L_2$-[SA]-X(n)<br>[SA]-$L_1$-[OX40-L]-$L_2$-[Nb]-X(n)<br>[SA]-$L_1$-[Nb]-$L_2$-[OX40-L]-X(n)<br>[OX40-L]-$L_1$-[OX40-L]-$L_2$-[Nb]-$L_3$-[SA]-X(n)<br>[Nb]-$L_1$-[OX40-L]-$L_2$-[OX40-L]-$L_3$-[SA]-X(n)<br>[SA]-$L_1$-[OX40-L]-$L_2$-[OX40-L]-$L_3$-[Nb]-X(n)<br>[SA]-$L_1$-[OX40-L]-$L_2$-[Nb]-$L_3$-[OX40-L]-X(n)<br>[OX40-L]-$L_1$-[Nb]-$L_2$-[OX40-L]-$L_3$-[SA]-X(n) | At least one [OX40-L] present is = one of SEQ ID NO's: 464 to 477 and/or 482 to 495 (4)<br>[SA] = (see legend below)<br>$L_1$, $L_2$, $L_3$(see legend below)<br>X(n) = (see legend below)<br>[Nb] = (see legend below) |

Legend:

[SA] is an ISV against (human) serum albumin, preferably an ISV of the invention against (human) serum albumin, more preferably one of SEQ ID NO's: 46 or 61 or even more preferably one of the ISVD's of the invention of SEQ ID NO's: 47, 54, 62, 69, 78, 86, 109, 116, 123, 130 or 496 to 513.

Each of $L_1$, $L_2$ and $L_3$ is (independently) a suitable linker. Each of $L_1$, $L_2$ and $L_3$ may (independently) be present or not. Non-limiting examples of suitable linkers are the gly-ser linkers referred to herein, such as the 9GS, 30GS or 35GS linker.

X(n) = a C-terminal extension as a C-terminal extension as described in herein and/or in WO 12/175741

[Nb] is an ISV against another therapeutic target.

Notes:

(1)In this Table:

"Monovalent" generally refers to polypeptides/constructs comprising a single ISV against OX40-L. These may further comprise a half-life extending ISV (such as an ISV against serum albumin).

"Bivalent" generally refers to polypeptides/constructs comprising two ISV's against OX40-L (which may be the same or different). These may again further comprise a half-life extending ISV (such as an ISV against serum albumin).

"Bispecific" generally refers to polypeptides/constructs comprising at least one (such as 1 or 2) ISV's against OX40-L and at least one (such as 1 or 2) other ISV against a therapeutic target. These may further comprise a half-life extending ISV (such as an ISV against serum albumin).

In the polypeptides/constructs described in this table, at least one of the ISV's against OX40-L present is an ISV of the invention, and preferably all of the ISV's against OX40-L present in such polypeptide/construct are ISV's of the invention. Also, when a half-life extending ISV and/or an ISV against another therapeutic target is present in such polypeptide/construct, each of these (and preferably all of these) may also be (and preferably are) ISV's of the invention (2)All "bivalent" constructs in this Table may also be biparatopic, meaning that they comprise at least two (such as two) ISV's against OX40-L, which are directed against different epitopes on OX40-L.

(3) As will be clear to the skilled person, other/further bispecific constructs than those listed can be made using the building blocks and linkers mentioned.

(4) Preferably, each [OX40-L] present is independently chosen from SEQ ID NO's: 464 to 477 and/or 482 to 495. Also, the [OX40-L] present may be the same or different; in a biparatopic polypeptide/construct they will be directed against different epitopes on OX40-L.

(5) Each of the polypeptides/constructs mentioned to in this column by means of reference to a SEQ ID forms an individual specific aspect of the invention.

Example 10: VH Domains (and in Particular Nanobodies) Against IgE, and Compounds of the Invention Comprising the Same In one specific aspect, the VH domains of the invention (and in particular ISVDs of the invention and more in particular Nanobodies of the invention) and compounds of the invention may be directed against IgE.

Such a VH domain of the invention against IgE will generally comprise: (i) suitable framework sequences that suitably comprise the amino acid residues/mutations of the invention as described herein; as well as (ii) CDR sequences that allow the VH domain of the invention to specifically bind to IgE. In addition, such a VH domain of the invention against IgE may also suitably have a C-terminal extension as described herein, in particular when said VH domain is monovalent or forms the C-terminal end of the compound of the invention in which said VH domain is present (again, as further described herein). Such VH domains of the invention against IgE may further be as further described herein, and may in particular be ISVD's.

Again, as with other aspects and embodiments of the invention described herein, when a specific ISVD (such as the ISVD against IgE described in this Example) or compound comprising the same is said to be "according to the invention" or "as further described herein", the preferred aspects/embodiments and preferences that are generally described herein for the ISVD's or compounds of the invention also specifically apply to said specific ISVD or compound, respectively, unless explicitly indicated otherwise or unless the specific technical context requires otherwise.

Thus, in a particular aspect, the present invention relates to a VH domain (and in particular an ISVD) that is directed against IgE, in which (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). In particular, in such VH domains against IgE:

- the amino acid residue at position 11 is preferably chosen from L, V or K (and is most preferably V); and
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v).

The VH domains of the invention against IgE may further be as described herein and may again in particular be an ISVD (and more in particular a Nanobody) against IgE or a protein, polypeptide or other compound or construct that comprises as least one such ISVD. Such a protein, polypeptide or other compound or construct may also be as further described herein, and may for example have an increased half-life (i.e. as described herein, e.g. a half-life—expressed as t1/2 beta—in human subjects of in human subjects of at least 1 day, preferably at least 3 days, more preferably at least 7 days, such as at least 10 days), and for this purpose may for example comprise a serum-albumin binding Nanobody, which may also be a serum-albumin binding Nanobody of the invention (again, as described herein).

Also, such an ISVD may suitably have a C-terminal extension (as further described herein and in WO 12/175741), in particular when said ISVD forms the C-terminal end of a protein, polypeptide or other compound or construct comprising the same (again, as further described herein).

In one preferred aspect, the VH domains of the invention against IgE comprise (i) a CDR1 sequence that is the sequence of SEQ ID NO: 227 (which is preferred) or that is an amino acid sequence that has only one amino acid difference with the sequence of SEQ ID NO: 227; (ii) a CDR2 sequence that is the sequence of SEQ ID NO: 228 (which is preferred) or that is an amino acid sequence that has only one or two amino acid differences with the sequence of SEQ ID NO: 228; and (iii) a CDR3 sequence that is the sequence of SEQ ID NO: 229 (which is preferred) or that is an amino acid sequence that has only one or two amino acid differences with the sequence of SEQ ID NO: 229.

More preferably, in a VH domain of the invention against IgE according to this aspect: (i) CDR1 is SEQ ID NO: 227; (ii) CDR2 is SEQ ID NO: 228; and (iii) CDR3 is SEQ ID NO: 229.

In one specific aspect, a Nanobody of the invention against IgE is a variant of the Nanobody of SEQ ID NO: 226 (with at least 90% sequence identity, such as at least 95% sequence identity, with SEQ ID NO: 226), in which:

- the amino acid residue at position 11 is preferably chosen from L, V or K (and is most
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). The CDR's of such an ISV are preferably as defined in the preceding two paragraphs.

Some specifically preferred, but non-limiting examples of Nanobodies of the invention against IgE are listed in FIG. 14 as SEQ ID NO's: 230 to 243; and each of these Nanobodies form a further aspect of the invention.

The invention also relates to a compound of the invention against IgE that comprises at least one (such as one, two or three) of the Nanobodies of the invention of SEQ ID NO's: 230 to 243. Such compounds of the invention against IgE may again be as further described herein, and thus for example may comprise suitable linkers, may comprise a C-terminal extension as described herein, and may be half-life extended (for example because they comprise a Nanobody against human serum albumin, such as (preferably) a Nanobody of the invention against human serum albumin). Reference is made to Table T below.

Some specifically preferred examples of compounds of the invention against IgE are given in FIG. 24 as SEQ ID NO's: 586 to 594; and each of these compounds form a further aspect of the invention. Thus, in another aspect, theinvention relates to a polypeptide that is directed against IgE and that has an amino acid sequence that is chosen from the group consisting of SEQ ID NO's: 586 to 594.

More generally, compounds of the invention against IgE may be as described in WO 2012/175740 and the relevant parts of WO2012/175400, but comprising ISV's of the invention. They may also be used for the purposes described in WO 2012/175740.

TABLE T

Examples of compounds of the invention against IgE.

| Polypeptide/ construct(1) | General formula | ISV building blocks and linkers |
|---|---|---|
| Monovalent | [IgE] | [IgE] = one of SEQ ID NO's: 464 to 477 and/or 482 to 495 |
| Monovalent/ C-terminal extension | [IgE]-X(n) | [IgE] = one of SEQ ID NO's: 464 to 477 and/or 482 to 495 |
| Monovalent/ half-life extended | [IgE]-$L_1$-[SA]<br>[SA]-$L_1$-[IgE] | [IgE] = one of SEQ ID NO's: 464 to 477 and/or 482 to 495<br>[SA] = (see legend below)<br>$L_1$ = (see legend below) |
| Monovalent/ half-life extended/ C-terminal extension | [IgE]-$L_1$-[SA]-X(n)<br>[SA]-$L_1$-[IgE]-X(n) | [IgE] = one of SEQ ID NO's: 464 to 477 and/or 482 to 495<br>[SA] = (see legend below)<br>$L_1$ = (see legend below)<br>X(n) = (see legend below) |
| Bivalent(2) | [IgE]-$L_1$-[IgE] | At least one [IgE] present is = one of SEQ ID NO's: 464 to 477 and/or 482 to 495 (4)<br>$L_1$ = (see legend below) |
| Bivalent/ C-terminal extension(2) | [IgE]-$L_1$-[IgE]-X(n) | At least one [IgE] = one of SEQ ID NO's: 464 to 477 and/or 482 to 495 (4)<br>$L_1$ = (see legend below)<br>X(n) = (see legend below) |
| Bivalent/ half-life extended(2) | [IgE]-$L_1$-[IgE]-$L_2$-[SA]<br>[IgE]-$L_1$-[SA]-$L_2$-[IgE]<br>[SA]-$L_1$-[IgE]-$L_2$-[IgE] | At least one [IgE] present is = one of SEQ ID NO's: 464 to 477 and/or 482 to 495 (4)<br>[SA] = (see legend below)<br>$L_1$ = (see legend below)<br>$L_2$ = (see legend below) |
| Bivalent/ half-life extended/ C-terminal extension(2) | [IgE]-$L_1$-[IgE]-$L_2$-[SA]-X(n)<br>[IgE]-$L_1$-[SA]-$L_2$-[IgE]-X(n)<br>[SA]-$L_1$-[IgE]-$L_2$-[IgE]-X(n) | At least one [IgE] present is = one of SEQ ID NO's: 464 to 477 and/or 482 to 495 (4)<br>[SA] = (see legend below)<br>$L_1$ = (see legend below)<br>$L_2$ = (see legend below)<br>X(n) = (see legend below) |
| Bispecific (3) | [IgE]-$L_1$-[Nb]<br>[Nb]-$L_1$-[IgE]<br>[IgE]-$L_1$-[IgE]-$L_2$-[Nb]<br>[IgE]-$L_1$-[Nb]-$L_2$-[IgE]<br>[Nb]-$L_1$-[IgE]-$L_2$-[IgE] | At least one [IgE] present is = one of SEQ ID NO's: 464 to 477 and/or 482 to 495 (4)<br>$L_1$ = (see legend below)<br>$L_2$ = (see legend below)<br>[Nb] = (see legend below) |
| Bispecific/ C-terminal extension (3) | [IgE]-$L_1$-[Nb]-X(n)<br>[Nb]-$L_1$-[IgE]-X(n)<br>[IgE]-$L_1$-[IgE]-$L_2$-[Nb]-X(n)<br>[IgE]-$L_1$-[Nb]-$L_2$-[IgE]-X(n)<br>[Nb]-$L_1$-[IgE]-$L_2$-[IgE]-X(n) | At least one [IgE] present is = one of SEQ ID NO's: 464 to 477 and/or 482 to 495 (4)<br>$L_1$ = (see legend below)<br>$L_2$ = (see legend below)<br>X(n) = (see legend below)<br>[Nb] = (see legend below) |
| Bispecific/ half-life extended (3) | [IgE]-$L_1$-[Nb]-$L_2$-[SA]<br>[IgE]-$L_1$-[SA]-$L_2$-[Nb]<br>[Nb]-$L_1$-[SA]-$L_2$-[IgE]<br>[Nb]-$L_1$-[IgE]-$L_2$-[SA]<br>[SA]-$L_1$-[IgE]-$L_2$-[Nb]<br>[SA]-$L_1$-[Nb]-$L_2$-[IgE] | At least one [IgE] present is = one of SEQ ID NO's: 464 to 477 and/or 482 to 495 (4)<br>[SA] = (see legend below)<br>$L_1$, $L_2$, $L_3$(see legend below)<br>[Nb] = (see legend below) |
| Bispecific/ half-life extended (3) | [IgE]-$L_1$-[IgE]-$L_2$-[Nb]-$L_3$-[SA]<br>[Nb]-$L_1$-[IgE]-$L_2$-[IgE]-$L_3$-[SA]<br>[SA]-$L_1$-[IgE]-$L_2$-[IgE]-$L_3$-[Nb]<br>[SA]-$L_1$-[IgE]-$L_2$-[Nb]-$L_3$-[IgE]<br>[IgE]-$L_1$-[Nb]-$L_2$-[IgE]-$L_3$-[SA] | At least one [IgE] present is = one of SEQ ID NO's: 464 to 477 and/or 482 to 495 (4)<br>[SA] = (see legend below)<br>$L_1$, $L_2$, $L_3$(see legend below)<br>[Nb] = (see legend below) |

TABLE T-continued

Examples of compounds of the invention against IgE.

| Polypeptide/ construct([1]) | General formula | ISV building blocks and linkers |
|---|---|---|
| Bispecific/ half-life extended/ C-terminal extension ([3]) | [IgE]-$L_1$-[Nb]-$L_2$-[SA]-X(n)<br>[IgE]-$L_1$-[SA]-$L_2$-[Nb]-X(n)<br>[Nb]-$L_1$-[SA]-$L_2$-[IgE]-X(n)<br>[Nb]-$L_1$-[IgE]-$L_2$-[SA]-X(n)<br>[SA]-$L_1$-[IgE]-$L_2$-[Nb]-X(n)<br>[SA]-$L_1$-[Nb]-$L_2$-[IgE]-X(n)<br>[IgE]-$L_1$-[IgE]-$L_2$-[Nb]-$L_3$-[SA]-X(n)<br>[Nb]-$L_1$-[IgE]-$L_2$-[IgE]-$L_3$-[SA]-X(n)<br>[SA]-$L_1$-[IgE]-$L_2$-[IgE]-$L_3$-[Nb]-X(n)<br>[SA]-$L_1$-[IgE]-$L_2$-[Nb]-$L_3$-[IgE]-X(n)<br>[IgE]-$L_1$-[Nb]-$L_2$-[IgE]-$L_3$-[SA]-X(n) | At least one [IgE] present is = one of SEQ ID NO's: 464 to 477 and/or 482 to 495 ([4])<br>[SA] = (see legend below)<br>$L_1$, $L_2$, $L_3$(see legend below)<br>X(n) = (see legend below)<br>[Nb] = (see legend below) |

Legend:

[SA] is an ISV against (human) serum albumin, preferably an ISV of the invention against (human) serum albumin, more preferably one of SEQ ID NO's: 46 or 61 or even more preferably one of the ISVD's of the invention of SEQ ID NO's: 47, 54, 62, 69, 78, 86, 109, 116, 123, 130 or 496 to 513.

Each of $L_1$, $L_2$ and $L_3$ is (independently) a suitable linker. Each of $L_1$, $L_2$ and $L_3$ may (independently) be present or not. Non-limiting examples of suitable linkers are the gly-ser linkers referred to herein, such as the 9GS, 30GS or 35GS linker.

X(n) = a C-terminal extension as a C-terminal extension as described in herein and/or in WO 12/175741

[Nb] is an ISV against another therapeutic target.

Notes:

([1])In this Table:

"Monovalent" generally refers to polypeptides/constructs comprising a single ISV against IgE. These may further comprise a half-life extending ISV (such as an ISV against serum albumin).

"Bivalent" generally refers to polypeptides/constructs comprising two ISV's against IgE (which may be the same or different). These may again further comprise a half-life extending ISV (such as an ISV against serum albumin).

"Bispecific" generally refers to polypeptides/constructs comprising at least one (such as 1 or 2) ISV's against IgE and at least one (such as 1 or 2) other ISV against a therapeutic target. These may further comprise a half-life extending ISV (such as an ISV against serum albumin). In the polypeptides/constructs described in this table, at least one of the ISV's against IgE present is an ISV of the invention, and preferably all of the ISV's against IgE present in such polypeptide/construct are ISV's of the invention. Also, when a half-life extending ISV and/or an ISV against another therapeutic target is present in such polypeptide/construct, each of these (and preferably all of these) may also be (and preferably are) ISV's of the invention ([2])All "bivalent" constructs in this Table may also be biparatopic, meaning that they comprise at least two (such as two) ISV's against IgE, which are directed against different epitopes on IgE.

([3]) As will be clear to the skilled person, other/further bispecific constructs than those listed can be made using the building blocks and linkers mentioned.

([4]) Preferably, each [IgE] present is independently chosen from SEQ ID NO's: 464 to 477 and/or 482 to 495. Also, the [IgE] present may be the same or different; in a biparatopic polypeptide/construct they will be directed against different epitopes on IgE.

([5]) Each of the polypeptides/constructs mentioned to in this column by means of reference to a SEQ ID forms an individual specific aspect of the invention.

Example 11: VH Domains (and in Particular Nanobodies) Against CXCR4, and Compounds of the Invention Comprising the Same In one specific aspect, the VH domains of the invention (and in particular ISVDs of the invention and more in particular Nanobodies of the invention) and compounds of the invention may be directed against CXCR4.

Such a VH domain of the invention against CXCR4 will generally comprise: (i) suitable framework sequences that suitably comprise the amino acid residues/mutations of the invention as described herein; as well as (ii) CDR sequences that allow the VH domain of the invention to specifically bind to CXCR4. In addition, such a VH domain of the invention against CXCR4 may also suitably have a C-terminal extension as described herein, in particular when said VH domain is monovalent or forms the C-terminal end of the compound of the invention in which said VH domain is present (again, as further described herein). Such VH domains of the invention against CXCR4 may further be as further described herein, and may in particular be ISVD's.

Again, as with other aspects and embodiments of the invention described herein, when a specific ISVD (such as the ISVD against CXCR4 described in this Example) or compound comprising the same is said to be "according to the invention" or "as further described herein", the preferred aspects/embodiments and preferences that are generally described herein for the ISVD's or compounds of the invention also specifically apply to said specific ISVD or compound, respectively, unless explicitly indicated otherwise or unless the specific technical context requires otherwise.

Thus, in a particular aspect, the present invention relates to a VH domain (and in particular an ISVD) that is directed against CXCR4, in which (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). In particular, in such VH domains against CXCR4:

- the amino acid residue at position 11 is preferably chosen from L, V or K (and is most preferably V); and
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v).

The VH domains of the invention against CXCR4 may further be as described herein and may again in particular be an ISVD (and more in particular a Nanobody) against CXCR4 or a protein, polypeptide or other compound or construct that comprises as least one such ISVD. Such a protein, polypeptide or other compound or construct may also be as further described herein, and may for example have an increased half-life (i.e. as described herein, e.g. a half-life—expressed as t1/2 beta—in human subjects of in human subjects of at least 1 day, preferably at least 3 days, more preferably at least 7 days, such as at least 10 days), and for this purpose may for example comprise a serum-albumin binding Nanobody, which may also be a serum-albumin binding Nanobody of the invention (again, as described herein).

Also, such an ISVD may suitably have a C-terminal extension (as further described herein and in WO 12/175741), in particular when said ISVD forms the C-terminal end of a protein, polypeptide or other compound or construct comprising the same (again, as further described herein).

In one preferred aspect, the VH domains of the invention against CXCR4 comprise (i) a CDR1 sequence that is the sequence of SEQ ID NO: 245 (which is preferred) or that is an amino acid sequence that has only one amino acid difference with the sequence of SEQ ID NO: 245; (ii) a CDR2 sequence that is the sequence of SEQ ID NO: 246 (which is preferred) or that is an amino acid sequence that has only one or two amino acid differences with the sequence of SEQ ID NO: 246; and (iii) a CDR3 sequence that is the sequence of SEQ ID NO: 247 (which is preferred) or that is an amino acid sequence that has only one or two amino acid differences with the sequence of SEQ ID NO: 247.

More preferably, in a VH domain of the invention against CXCR4 according to this aspect: (i) CDR1 is SEQ ID NO: 245; (ii) CDR2 is SEQ ID NO: 246; and (iii) CDR3 is SEQ ID NO: 247.

In one specific aspect, a Nanobody of the invention against CXCR4 is a variant of the Nanobody of SEQ ID NO: 244 (with at least 90% sequence identity, such as at least 95% sequence identity, with SEQ ID NO: 244), in which:

- the amino acid residue at position 11 is preferably chosen from L, V or K (and is most
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). The CDR's of such an ISV are preferably as defined in the preceding two paragraphs.

In another preferred aspect, the VH domains of the invention against CXCR4 comprise (i) a CDR1 sequence that is the sequence of SEQ ID NO: 263 (which is preferred) or that is an amino acid sequence that has only one amino acid difference with the sequence of SEQ ID NO: 263; (ii) a CDR2 sequence that is the sequence of SEQ ID NO: 264 (which is preferred) or that is an amino acid sequence that has only one or two amino acid differences with the sequence of SEQ ID NO: 264; and (iii) a CDR3 sequence that is the sequence of SEQ ID NO: 265 (which is preferred) or that is an amino acid sequence that has only one or two amino acid differences with the sequence of SEQ ID NO: 265.

More preferably, in a VH domain of the invention against CXCR-4 according to this aspect: (i) CDR1 is SEQ ID NO: 263; (ii) CDR2 is SEQ ID NO: 264; and (iii) CDR3 is SEQ ID NO: 265.

In one specific aspect, a Nanobody of the invention against IL-23 is a variant of the Nanobody of SEQ ID NO: 262 (with at least 90% sequence identity, such as at least 95% sequence identity, with SEQ ID NO: 262), in which:

- the amino acid residue at position 11 is preferably chosen from L, V or K (and is most preferably V); and
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q:

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). Again, the CDR's of such an ISV are preferably as defined in the preceding two paragraphs.

Some specifically preferred, but non-limiting examples of Nanobodies of the invention against CXCR4 are listed in FIG. 15A as SEQ ID NO's: 248 to 261 and in FIG. 15B as SEQ ID NO's: 266 to 279; and each of these Nanobodies form a further aspect of the invention.

The invention also relates to a compound of the invention against CXCR4 that comprises at least one (such as one, two or three) of the Nanobodies of the invention of SEQ ID NO's: 248 to 261 and/or 266 to 279. Such compounds of the invention against CXCR4 may again be as further described herein, and thus for example may comprise suitable linkers, may comprise a C-terminal extension as described herein, and may be half-life extended (for example because they comprise a Nanobody against human serum albumin, such as (preferably) a Nanobody of the invention against human serum albumin). Reference is made to Table U below.

As described in for example WO 2009/138519, WO 2011/042398 and WO 2011/161266, one particularly preferred class of Nanobody-based compounds against CXCR4 are biparatopic compounds. Thus, in one aspect of the invention, a compound of the invention against CXCR4 is a biparatopic construct that comprises one ISV that is either SEQ ID NO: 244 or (preferably) an ISV of the invention that has been derived from SEQ ID NO: 244 (as described in this Example 11) and one ISV that is either SEQ ID NO: 262 or (preferably) an ISV of the invention that has been derived from SEQ ID NO: 262 (as described in this Example 11), provided that at least one (and preferably both) of these ISV's are ISV's of the invention. Such biparatopic constructs may also be half-life extended (i.e. by means of a serum albumin-binding ISV). Some specific examples of such biparatopic constructs are given in SEQ ID NO: 595 to 603.

Some specifically preferred examples of compounds of the invention against CXCR-4 are given in FIG. 25 as SEQ ID NO's: 595 to 603; and each of these compounds form a further aspect of the invention. Thus, in another aspect, the invention relates to a polypeptide that is directed against CXCR-4 and that has an amino acid sequence that is chosen from the group consisting of SEQ ID NO's: 595 to 603. More generally, compounds of the invention against CXCR-4 may be as described in WO 2009/138519, WO 2011/042398 and WO 2011/161266WO 2011/144749, but comprising ISV's of the invention. They may also be used for the purposes described in WO 2009/138519, WO 2011/042398 and WO 2011/161266.

TABLE U

Examples of compounds of the invention against CXCR-4.

| Polypeptide/ construct([1]) | General formula | ISV building blocks and linkers |
|---|---|---|
| Monovalent | [CXCR-4] | [CXCR-4] = one of SEQ ID NO's: 464 to 477 and/or 482 to 495 |
| Monovalent/ C-terminal extension | [CXCR-4]-X(n) | [CXCR-4] = one of SEQ ID NO's: 464 to 477 and/or 482 to 495 |
| Monovalent/ half-life extended | [CXCR-4]-$L_1$-[SA]<br>[SA]-$L_1$-[CXCR-4] | [CXCR-4] = one of SEQ ID NO's: 464 to 477 and/or 482 to 495<br>[SA] = (see legend below)<br>$L_1$ = (see legend below) |
| Monovalent/ half-life extended/ C-terminal extension | [CXCR-4]-$L_1$-[SA]-X(n)<br>[SA]-$L_1$-[CXCR-4]-X(n) | [CXCR-4] = one of SEQ ID NO's: 464 to 477 and/or 482 to 495<br>[SA] = (see legend below)<br>$L_1$ = (see legend below)<br>X(n) = (see legend below) |
| Bivalent([2]) | [CXCR-4]-$L_1$-[CXCR-4] | At least one [CXCR-4] present is = one of SEQ ID NO's: 464 to 477 and/or 482 to 495 ([4])<br>$L_1$ = (see legend below) |
| Bivalent/ C-terminal extension([2]) | [CXCR-4]-$L_1$-[CXCR-4]-X(n) | At least one [CXCR-4] = one of SEQ ID NO's: 464 to 477 and/or 482 to 495 ([4])<br>$L_1$ = (see legend below)<br>X(n) = (see legend below) |
| Bivalent/ half-life extended([2]) | [CXCR-4]-$L_1$-[CXCR-4]-$L_2$-[SA]<br>[CXCR-4]-$L_1$-[SA]-$L_2$-[CXCR-4]<br>[SA]-$L_1$-[CXCR-4]-$L_2$-[CXCR-4] | At least one [CXCR-4] present is = one of SEQ ID NO's: 464 to 477 and/or 482 to 495 ([4])<br>[SA] = (see legend below)<br>$L_1$ = (see legend below)<br>$L_2$ = (see legend below) |
| Bivalent/ half-life extended/ C-terminal extension([2]) | [CXCR-4]-$L_1$-[CXCR-4]-$L_2$-[SA]-X(n)<br>[CXCR-4]-$L_1$-[SA]-$L_2$-[CXCR-4]-X(n)<br>[SA]-$L_1$-[CXCR-4]-$L_2$-[CXCR-4]-X(n) | At least one [CXCR-4] present is = one of SEQ ID NO's: 464 to 477 and/or 482 to 495 ([4])<br>[SA] = (see legend below)<br>$L_1$ = (see legend below)<br>$L_2$ = (see legend below)<br>X(n) = (see legend below) |
| Bispecific ([3]) | [CXCR-4]-$L_1$-[Nb]<br>[Nb]-$L_1$-[CXCR-4]<br>[CXCR-4]-$L_1$-[CXCR-4]-$L_2$-[Nb]<br>[CXCR-4]-$L_1$-[Nb]-$L_2$-[CXCR-4]<br>[Nb]-$L_1$-[CXCR-4]-$L_2$-[CXCR-4] | At least one [CXCR-4] present is = one of SEQ ID NO's: 464 to 477 and/or 482 to 495 ([4])<br>$L_1$ = (see legend below)<br>$L_2$ = (see legend below)<br>[Nb] = (see legend below) |
| Bispecific/ C-terminal extension ([3]) | [CXCR-4]-$L_1$-[Nb]-X(n)<br>[Nb]-$L_1$-[CXCR-4]-X(n)<br>[CXCR-4]-$L_1$-[CXCR-4]-$L_2$-[Nb]-X(n)<br>[CXCR-4]-$L_1$-[Nb]-$L_2$-[CXCR-4]-X(n)<br>[Nb]-$L_1$-[CXCR-4]-$L_2$-[CXCR-4]-X(n) | At least one [CXCR-4] present is = one of SEQ ID NO's: 464 to 477 and/or 482 to 495 ([4])<br>$L_1$ = (see legend below)<br>$L_2$ = (see legend below)<br>X(n) = (see legend below)<br>[Nb] = (see legend below) |
| Bispecific/ half-life extended ([3]) | [CXCR-4]-$L_1$-[Nb]-$L_2$-[SA]<br>[CXCR-4]-$L_1$-[SA]-$L_2$-[Nb]<br>[Nb]-$L_1$-[SA]-$L_2$-[CXCR-4]<br>[Nb]-$L_1$-[CXCR-4]-$L_2$-[SA]<br>[SA]-$L_1$-[CXCR-4]-$L_2$-[Nb]<br>[SA]-$L_1$-[Nb]-$L_2$-[CXCR-4] | At least one [CXCR-4] present is = one of SEQ ID NO's: 464 to 477 and/or 482 to 495 ([4])<br>[SA] = (see legend below)<br>$L_1$, $L_2$, $L_3$(see legend below)<br>[Nb] = (see legend below) |
| Bispecific/ half-life extended ([3]) | [CXCR-4]-$L_1$-[CXCR-4]-$L_2$-[Nb]-$L_3$-[SA]<br>[Nb]-$L_1$-[CXCR-4]-$L_2$-[CXCR-4]-$L_3$-[SA]<br>[SA]-$L_1$-[CXCR-4]-$L_2$-[CXCR-4]-$L_3$-[Nb]<br>[SA]-$L_1$-[CXCR-4]-$L_2$-[Nb]-$L_3$-[CXCR-4]<br>[CXCR-4]-$L_1$-[Nb]-$L_2$-[CXCR-4]-$L_3$-[SA] | At least one [CXCR-4] present is = one of SEQ ID NO's: 464 to 477 and/or 482 to 495 ([4])<br>[SA] = (see legend below)<br>$L_1$, $L_2$, $L_3$(see legend below)<br>[Nb] = (see legend below) |

TABLE U-continued

| Examples of compounds of the invention against CXCR-4. | | |
|---|---|---|
| Polypeptide/ construct([1]) | General formula | ISV building blocks and linkers |
| Bispecific/ half-life extended/ C-terminal extension ([3]) | [CXCR-4]-$L_1$-[Nb]-$L_2$-[SA]-X(n)<br>[CXCR-4]-$L_1$-[SA]-$L_2$-[Nb]-X(n)<br>[Nb]-$L_1$-[SA]-$L_2$-[CXCR-4]-X(n)<br>[Nb]-$L_1$-[CXCR-4]-$L_2$-[SA]-X(n)<br>[SA]-$L_1$-[CXCR-4]-$L_2$-[Nb]-X(n)<br>[SA]-$L_1$-[Nb]-$L_2$-[CXCR-4]-X(n)<br>[CXCR-4]-$L_1$-[CXCR-4]-$L_2$-[Nb]-$L_3$-[SA]-X(n)<br>[Nb]-$L_1$-[CXCR-4]-$L_2$-[CXCR-4]-$L_3$-[SA]-X(n)<br>[SA]-$L_1$-[CXCR-4]-$L_2$-[CXCR-4]-$L_3$-[Nb]-X(n)<br>[SA]-$L_1$-[CXCR-4]-$L_2$-[Nb]-$L_3$-[CXCR-4]-X(n)<br>[CXCR-4]-$L_1$-[Nb]-$L_2$-[CXCR-4]-$L_3$-[SA]-X(n) | At least one [CXCR-4] present is = one of SEQ ID NO's: 464 to 477 and/or 482 to 495 ([4])<br>[SA] = (see legend below)<br>$L_1$, $L_2$, $L_3$(see legend below)<br>X(n) = (see legend below)<br>[Nb] = (see legend below) |

Legend:

[SA] is an ISV against (human) serum albumin, preferably an ISV of the invention against (human) serum albumin, more preferably one of SEQ ID NO's: 46 or 61 or even more preferably one of the ISVD's of the invention of SEQ ID NO's: 47, 54, 62, 69, 78, 86, 109, 116, 123, 130 or 496 to 513.

Each of $L_1$, $L_2$ and $L_3$ is (independently) a suitable linker. Each of $L_1$, $L_2$ and $L_3$ may (independently) be present or not. Non-limiting examples of suitable linkers are the gly-ser linkers referred to herein, such as the 9GS, 30GS or 35GS linker.

X(n) = a C-terminal extension as a C-terminal extension as described in herein and/or in WO 12/175741

[Nb] is an ISV against another therapeutic target.

Notes:

([1])In this Table:

"Monovalent" generally refers to polypeptides/constructs comprising a single ISV against CXCR-4. These may further comprise a half-life extending ISV (such as an ISV against serum albumin).

"Bivalent" generally refers to polypeptides/constructs comprising two ISV's against CXCR-4 (which may be the same or different). These may again further comprise a half-life extending ISV (such as an ISV against serum albumin).

"Bispecific" generally refers to polypeptides/constructs comprising at least one (such as 1 or 2) ISV's against CXCR-4 and at least one (such as 1 or 2) other ISV against a therapeutic target. These may further comprise a half-life extending ISV (such as an ISV against serum albumin).

In the polypeptides/constructs described in this table, at least one of the ISV's against CXCR-4 present is an ISV of the invention, and preferably all of the ISV's against CXCR-4 present in such polypeptide/construct are ISV's of the invention. Also, when a half-life extending ISV and/or an ISV against another therapeutic target is present in such polypeptide/construct, each of these (and preferably all of these) may also be (and preferably are) ISV's of the invention ([2])All "bivalent" constructs in this Table may also be biparatopic, meaning that they comprise at least two (such as two) ISV's against CXCR-4, which are directed against different epitopes on CXCR-4.

([3]) As will be clear to the skilled person, other/further bispecific constructs than those listed can be made using the building blocks and linkers mentioned.

([4]) Preferably, each [CXCR-4] present is independently chosen from SEQ ID NO's: 464 to 477 and/or 482 to 495. Also, the [CXCR-4] present may be the same or different; in a biparatopic polypeptide/construct they will be directed against different epitopes on CXCR-4.

([5]) Each of the polypeptides/constructs mentioned to in this column by means of reference to a SEQ ID forms an individual specific aspect of the invention.

Example 12: VH Domains (and in Particular Nanobodies) Against HER-3, and Compounds of the Invention Comprising the Same In one specific aspect, the VH domains of the invention (and in particular ISVDs of the invention and more in particular Nanobodies of the invention) and compounds of the invention may be directed against HER-3.

Such a VH domain of the invention against HER-3 will generally comprise: (i) suitable framework sequences that suitably comprise the amino acid residues/mutations of the invention as described herein; as well as (ii) CDR sequences that allow the VH domain of the invention to specifically bind to HER-3. In addition, such a VH domain of the invention against HER-3 may also suitably have a C-terminal extension as described herein, in particular when said VH domain is monovalent or forms the C-terminal end of the compound of the invention in which said VH domain is present (again, as further described herein). Such VH domains of the invention against HER-3 may further be as further described herein, and may in particular be ISVD's.

Again, as with other aspects and embodiments of the invention described herein, when a specific ISVD (such as the ISVD against HER-3 described in this Example) or compound comprising the same is said to be "according to the invention" or "as further described herein", the preferred aspects/embodiments and preferences that are generally described herein for the ISVD's or compounds of the invention also specifically apply to said specific ISVD or compound, respectively, unless explicitly indicated otherwise or unless the specific technical context requires otherwise.

Thus, in a particular aspect, the present invention relates to a VH domain (and in particular an ISVD) that is directed against HER-3, in which (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). In particular, in such VH domains against HER-3:

- the amino acid residue at position 11 is preferably chosen from L, V or K (and is most preferably V); and
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v).

The VH domains of the invention against HER-3 may further be as described herein and may again in particular be an ISVD (and more in particular a Nanobody) against HER-3 or a protein, polypeptide or other compound or construct that comprises as least one such ISVD. Such a protein, polypeptide or other compound or construct may also be as further described herein, and may for example have an increased half-life (i.e. as described herein, e.g. a half-life—expressed as t1/2 beta—in human subjects of in human subjects of at least 1 day, preferably at least 3 days, more preferably at least 7 days, such as at least 10 days), and for this purpose may for example comprise a serum-albumin binding Nanobody, which may also be a serum-albumin binding Nanobody of the invention (again, as described herein).

Also, such an ISVD may suitably have a C-terminal extension (as further described herein and in WO 12/175741), in particular when said ISVD forms the C-terminal end of a protein, polypeptide or other compound or construct comprising the same (again, as further described herein).

In one preferred aspect, the VH domains of the invention against HER-3 comprise (i) a CDR1 sequence that is the sequence of SEQ ID NO: 281 (which is preferred) or that is an amino acid sequence that has only one amino acid difference with the sequence of SEQ ID NO: 281; (ii) a CDR2 sequence that is the sequence of SEQ ID NO: 282 (which is preferred) or that is an amino acid sequence that has only one or two amino acid differences with the sequence of SEQ ID NO: 282; and (iii) a CDR3 sequence that is the sequence of SEQ ID NO: 283 (which is preferred) or that is an amino acid sequence that has only one or two amino acid differences with the sequence of SEQ ID NO: 283.

More preferably, in a VH domain of the invention against HER-3 according to this aspect: (i) CDR1 is SEQ ID NO: 281; (ii) CDR2 is SEQ ID NO: 282; and (iii) CDR3 is SEQ ID NO: 283.

In one specific aspect, a Nanobody of the invention against HER-3 is a variant of the Nanobody of SEQ ID NO: 280 (with at least 90% sequence identity, such as at least 95% sequence identity, with SEQ ID NO: 280), in which:

- the amino acid residue at position 11 is preferably chosen from L, V or K (and is most
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). The CDR's of such an ISV are preferably as defined in the preceding two paragraphs.

In another preferred aspect, the VH domains of the invention against HER-3 comprise (i) a CDR1 sequence that is the sequence of SEQ ID NO: 299 (which is preferred) or that is an amino acid sequence that has only one amino acid difference with the sequence of SEQ ID NO: 299; (ii) a CDR2 sequence that is the sequence of SEQ ID NO: 300 (which is preferred) or that is an amino acid sequence that has only one or two amino acid differences with the sequence of SEQ ID NO: 300; and (iii) a CDR3 sequence that is the sequence of SEQ ID NO: 301 (which is preferred) or that is an amino acid sequence that has only one or two amino acid differences with the sequence of SEQ ID NO: 301.

More preferably, in a VH domain of the invention against HER-3 according to this aspect: (i) CDR1 is SEQ ID NO: 299; (ii) CDR2 is SEQ ID NO: 300; and (iii) CDR3 is SEQ ID NO: 301.

In one specific aspect, a Nanobody of the invention against HER-3 is a variant of the Nanobody of SEQ ID NO: 298 (with at least 90% sequence identity, such as at least 95% sequence identity, with SEQ ID NO: 298), in which:

- the amino acid residue at position 11 is preferably chosen from L, V or K (and is most preferably V); and
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q:

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). Again, the CDR's of such an ISV are preferably as defined in the preceding two paragraphs.

Some specifically preferred, but non-limiting examples of Nanobodies of the invention against HER-3 are listed in FIG. 16A as SEQ ID NO's: 284 to 297 and FIG. 16B as SEQ ID NO's: 302 to 315, respectively; and each of these Nanobodies form a further aspect of the invention.

The invention also relates to a compound of the invention against HER-3 that comprises at least one (such as one, two or three) of the Nanobodies of the invention of SEQ ID NO's: 284 to 297 and/or 302 to 315. Such compounds of the invention against HER-3 may again be as further described herein, and thus for example may comprise suitable linkers, may comprise a C-terminal extension as described herein, and may be half-life extended (for example because they comprise a Nanobody against human serum albumin, such as (preferably) a Nanobody of the invention against human serum albumin). Reference is made to Table V below.

As described in for example WO 2011/144749, one particularly preferred class of Nanobody-based compounds against HER-3 are biparatopic compounds. Thus, in one aspect of the invention, a compound of the invention against HER-3 is a biparatopic construct that comprises one ISV that is either SEQ ID NO: 280 or (preferably) an ISV of the invention that has been derived from SEQ ID NO: 280 (as described in this Example 12) and one ISV that is either SEQ ID NO: 298 or (preferably) an ISV of the invention that has been derived from SEQ ID NO: 298 (as described in this Example 12), provided that at least one (and preferably both) of these ISV's are ISV's of the invention. Such biparatopic constructs may also be half-life extended (i.e. by means of a serum albumin-binding ISV). Some specific examples of such biparatopic constructs are given in SEQ ID NO: 604 to 639.

Some specifically preferred examples of compounds of the invention against HER-3 are given in FIG. 26 as SEQ ID NO's: 604 to 639; and each of these compounds form a further aspect of the invention. Thus, in another aspect, the invention relates to a polypeptide that is directed against HER-3 and that has an amino acid sequence that is chosen from the group consisting of SEQ ID NO's: 604 to 639. More generally, compounds of the invention against HER-3 may be as described in WO 2011/144749, but comprising ISV's of the invention. They may also be used for the purposes described in WO 2011/144749.

TABLE V

Examples of compounds of the invention against HER-3.

| Polypeptide/ construct([1]) | General formula | ISV building blocks and linkers |
|---|---|---|
| Monovalent | [HER-3] | [HER-3] = one of SEQ ID NO's: 464 to 477 and/or 482 to 495 |
| Monovalent/ C-terminal extension | [HER-3]-X(n) | [HER-3] = one of SEQ ID NO's: 464 to 477 and/or 482 to 495 |
| Monovalent/ half-life extended | [HER-3]-$L_1$-[SA]<br>[SA]-$L_1$-[HER-3] | [HER-3] = one of SEQ ID NO's: 464 to 477 and/or 482 to 495<br>[SA] = (see legend below)<br>$L_1$ = (see legend below) |
| Monovalent/ half-life extended/ C-terminal extension | [HER-3]-$L_1$-[SA]-X(n)<br>[SA]-$L_1$-[HER-3]-X(n) | [HER-3] = one of SEQ ID NO's: 464 to 477 and/or 482 to 495<br>[SA] = (see legend below)<br>$L_1$ = (see legend below)<br>X(n) = (see legend below) |
| Bivalent([2]) | [HER-3]-$L_1$-[HER-3] | At least one [HER-3] present is = one of SEQ ID NO's: 464 to 477 and/or 482 to 495 ([4])<br>$L_1$ = (see legend below) |
| Bivalent/ C-terminal extension([2]) | [HER-3]-$L_1$-[HER-3]-X(n) | At least one [HER-3] = one of SEQ ID NO's: 464 to 477 and/or 482 to 495 ([4])<br>$L_1$ = (see legend below)<br>X(n) = (see legend below) |
| Bivalent/ half-life extended([2]) | [HER-3]-$L_1$-[HER-3]-$L_2$-[SA]<br>[HER-3]-$L_1$-[SA]-$L_2$-[HER-3]<br>[SA]-$L_1$-[HER-3]-$L_2$-[HER-3] | At least one [HER-3] present is = one of SEQ ID NO's: 464 to 477 and/or 482 to 495 ([4])<br>[SA] = (see legend below)<br>$L_1$ = (see legend below)<br>$L_2$ = (see legend below) |
| Bivalent/ half-life extended/ C-terminal extension([2]) | [HER-3]-$L_1$-[HER-3]-$L_2$-[SA]-X(n)<br>[HER-3]-$L_1$-[SA]-$L_2$-[HER-3]-X(n)<br>[SA]-$L_1$-[HER-3]-$L_2$-[HER-3]-X(n) | At least one [HER-3] present is = one of SEQ ID NO's: 464 to 477 and/or 482 to 495 ([4])<br>[SA] = (see legend below)<br>$L_1$ = (see legend below)<br>$L_2$ = (see legend below)<br>X(n) = (see legend below) |
| Bispecific ([3]) | [HER-3]-$L_1$-[Nb]<br>[Nb]-$L_1$-[HER-3]<br>[HER-3]-$L_1$-[HER-3]-$L_2$-[Nb]<br>[HER-3]-$L_1$-[Nb]-$L_2$-[HER-3]<br>[Nb]-$L_1$-[HER-3]-$L_2$-[HER-3] | At least one [HER-3] present is = one of SEQ ID NO's: 464 to 477 and/or 482 to 495 ([4])<br>$L_1$ = (see legend below)<br>$L_2$ = (see legend below)<br>[Nb] = (see legend below) |
| Bispecific/ C-terminal extension ([3]) | [HER-3]-$L_1$-[Nb]-X(n)<br>[Nb]-$L_1$-[HER-3]-X(n)<br>[HER-3]-$L_1$-[HER-3]-$L_2$-[Nb]-X(n)<br>[HER-3]-$L_1$-[Nb]-$L_2$-[HER-3]-X(n)<br>[Nb]-$L_1$-[HER-3]-$L_2$-[HER-3]-X(n) | At least one [HER-3] present is = one of SEQ ID NO's: 464 to 477 and/or 482 to 495 ([4])<br>$L_1$ = (see legend below)<br>$L_2$ = (see legend below)<br>X(n) = (see legend below)<br>[Nb] = (see legend below) |
| Bispecific/ half-life extended ([3]) | [HER-3]-$L_1$-[Nb]-$L_2$-[SA]<br>[HER-3]-$L_1$-[SA]-$L_2$-[Nb]<br>[Nb]-$L_1$-[SA]-$L_2$-[HER-3]<br>[Nb]-$L_1$-[HER-3]-$L_2$-[SA]<br>[SA]-$L_1$-[HER-3]-$L_2$-[Nb]<br>[SA]-$L_1$-[Nb]-$L_2$-[HER-3] | At least one [HER-3] present is = one of SEQ ID NO's: 464 to 477 and/or 482 to 495 ([4])<br>[SA] = (see legend below)<br>$L_1$, $L_2$, $L_3$(see legend below)<br>[Nb] = (see legend below) |
| Bispecific/ half-life extended ([3]) | [HER-3]-$L_1$-[HER-3]-$L_2$-[Nb]-$L_3$-[SA]<br>[Nb]-$L_1$-[HER-3]-$L_2$-[HER-3]-$L_3$-[SA]<br>[SA]-$L_1$-[HER-3]-$L_2$-[HER-3]-$L_3$-[Nb]<br>[SA]-$L_1$-[HER-3]-$L_2$-[Nb]-$L_3$-[HER-3]<br>[HER-3]-$L_1$-[Nb]-$L_2$-[HER-3]-$L_3$-[SA] | At least one [HER-3] present is = one of SEQ ID NO's: 464 to 477 and/or 482 to 495 ([4])<br>[SA] = (see legend below)<br>$L_1$, $L_2$, $L_3$(see legend below)<br>[Nb] = (see legend below) |

TABLE V-continued

Examples of compounds of the invention against HER-3.

| Polypeptide/ construct([1]) | General formula | ISV building blocks and linkers |
|---|---|---|
| Bispecific/ half-life extended/ C-terminal extension ([3]) | [HER-3]-$L_1$-[Nb]-$L_2$-[SA]-X(n)<br>[HER-3]-$L_1$-[SA]-$L_2$-[Nb]-X(n)<br>[Nb]-$L_1$-[SA]-$L_2$-[HER-3]-X(n)<br>[Nb]-$L_1$-[HER-3]-$L_2$-[SA]-X(n)<br>[SA]-$L_1$-[HER-3]-$L_2$-[Nb]-X(n)<br>[SA]-$L_1$-[Nb]-$L_2$-[HER-3]-X(n)<br>[HER-3]-$L_1$-[HER-3]-$L_2$-[Nb]-$L_3$-[SA]-X(n)<br>[Nb]-$L_1$-[HER-3]-$L_2$-[HER-3]-$L_3$-[SA]-X(n)<br>[SA]-$L_1$-[HER-3]-$L_2$-[HER-3]-$L_3$-[Nb]-X(n)<br>[SA]-$L_1$-[HER-3]-$L_2$-[Nb]-$L_3$-[HER-3]-X(n)<br>[HER-3]-$L_1$-[Nb]-$L_2$-[HER-3]-$L_3$-[SA]-X(n) | At least one [HER-3] present is = one of SEQ ID NO's: 464 to 477 and/or 482 to 495 ([4])<br>[SA] = (see legend below)<br>$L_1$, $L_2$, $L_3$(see legend below)<br>X(n) = (see legend below)<br>[Nb] = (see legend below) |

Legend:

[SA] is an ISV against (human) serum albumin, preferably an ISV of the invention against (human) serum albumin, more preferably one of SEQ ID NO's: 46 or 61 or even more preferably one of the ISVD's of the invention of SEQ ID NO's: 47, 54, 62, 69, 78, 86, 109, 116, 123, 130 or 496 to 513.

Each of $L_1$, $L_2$ and $L_3$ is (independently) a suitable linker. Each of $L_1$, $L_2$ and $L_3$ may (independently) be present or not. Non-limiting examples of suitable linkers are the gly-ser linkers referred to herein, such as the 9GS, 30GS or 35GS linker.

X(n) = a C-terminal extension as a C-terminal extension as described in herein and/or in WO 12/175741

[Nb] is an ISV against another therapeutic target.

Notes:

([1])In this Table:

"Monovalent" generally refers to polypeptides/constructs comprising a single ISV against HER-3. These may further comprise a half-life extending ISV (such as an ISV against serum albumin).

"Bivalent" generally refers to polypeptides/constructs comprising two ISV's against HER-3 (which may be the same or different). These may again further comprise a half-life extending ISV (such as an ISV against serum albumin).

"Bispecific" generally refers to polypeptides/constructs comprising at least one (such as 1 or 2) ISV's against HER-3 and at least one (such as 1 or 2) other ISV against a therapeutic target. These may farther comprise a half-life extending ISV (such as an ISV against serum albumin).

In the polypeptides/constructs described in this table, at least one of the ISV's against HER-3 present is an ISV of the invention, and preferably all of the ISV's against HER-3 present in such polypeptide/construct are ISV's of the invention. Also, when a half-life extending ISV and/or an ISV against another therapeutic target is present in such polypeptide/construct, each of these (and preferably all of these) may also be (and preferably are) ISV's of the invention ([2])All "bivalent" constructs in this Table may also be biparatopic, meaning that they comprise at least two (such as two) ISV's against HER-3, which are directed against different epitopes on HER-3.

([3]) As will be clear to the skilled person, other/further bispecific constructs than those listed can be made using the building blocks and linkers mentioned.

([4]) Preferably, each [HER-3] present is independently chosen from SEQ ID NO's: 464 to 477 and/or 482 to 495. Also, the [HER-3] present may be the same or different; in a biparatopic polypeptide/construct they will be directed against different epitopes on HER-3.

([5]) Each of the polypeptides/constructs mentioned to in this column by means of reference to a SEQ ID forms an individual specific aspect of the invention.

Example 13: VH Domains (and in Particular Nanobodies) Against TNF, and Compounds of the Invention Comprising the Same In one specific aspect, the VH domains of the invention (and in particular ISVDs of the invention and more in particular Nanobodies of the invention) and compounds of the invention may be directed against TNF.

Such a VH domain of the invention against TNF will generally comprise: (i) suitable framework sequences that suitably comprise the amino acid residues/mutations of the invention as described herein; as well as (ii) CDR sequences that allow the VH domain of the invention to specifically bind to TNF. In addition, such a VH domain of the invention against TNF may also suitably have a C-terminal extension as described herein, in particular when said VH domain is monovalent or forms the C-terminal end of the compound of the invention in which said VH domain is present (again, as further described herein). Such VH domains of the invention against TNF may further be as further described herein, and may in particular be ISVD's.

Again, as with other aspects and embodiments of the invention described herein, when a specific ISVD (such as the ISVD against TNF described in this Example) or compound comprising the same is said to be "according to the invention" or "as further described herein", the preferred aspects/embodiments and preferences that are generally described herein for the ISVD's or compounds of the invention also specifically apply to said specific ISVD or compound, respectively, unless explicitly indicated otherwise or unless the specific technical context requires otherwise.

Thus, in a particular aspect, the present invention relates to a VH domain (and in particular an ISVD) that is directed against TNF, in which (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). In particular, in such VH domains against TNF:

- the amino acid residue at position 11 is preferably chosen from L, V or K (and is most preferably V); and
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v).

The VH domains of the invention against TNF may further be as described herein and may again in particular be an ISVD (and more in particular a Nanobody) against TNF or a protein, polypeptide or other compound or construct that comprises as least one such ISVD. Such a protein, polypeptide or other compound or construct may also be as further described herein, and may for example have an increased half-life (i.e. as described herein, e.g. a half-life—expressed as t1/2 beta—in human subjects of in human subjects of at least 1 day, preferably at least 3 days, more preferably at least 7 days, such as at least 10 days), and for this purpose may for example comprise a serum-albumin binding Nanobody, which may also be a serum-albumin binding Nanobody of the invention (again, as described herein).

Also, such an ISVD may suitably have a C-terminal extension (as further described herein and in WO 12/175741), in particular when said ISVD forms the C-terminal end of a protein, polypeptide or other compound or construct comprising the same (again, as further described herein).

In one preferred aspect, the VH domains of the invention against TNF comprise (i) a CDR1 sequence that is the sequence of SEQ ID NO: 317 (which is preferred) or that is an amino acid sequence that has only one amino acid difference with the sequence of SEQ ID NO: 317; (ii) a CDR2 sequence that is the sequence of SEQ ID NO: 318 (which is preferred) or that is an amino acid sequence that has only one or two amino acid differences with the sequence of SEQ ID NO: 318; and (iii) a CDR3 sequence that is the sequence of SEQ ID NO: 319 (which is preferred) or that is an amino acid sequence that has only one or two amino acid differences with the sequence of SEQ ID NO: 319.

More preferably, in a VH domain of the invention against TNF according to this aspect: (i) CDR1 is SEQ ID NO: 317; (ii) CDR2 is SEQ ID NO: 318; and (iii) CDR3 is SEQ ID NO: 319.

In one specific aspect, a Nanobody of the invention against TNF is a variant of the Nanobody of SEQ ID NO: 316 (with at least 90% sequence identity, such as at least 95% sequence identity, with SEQ ID NO: 316), in which:

- the amino acid residue at position 11 is preferably chosen from L, V or K (and is most
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). The CDR's of such an ISV are preferably as defined in the preceding two paragraphs.

Some specifically preferred, but non-limiting examples of Nanobodies of the invention against TNF are listed in FIG. 17A as SEQ ID NO's: 320 to 333; and each of these Nanobodies form a further aspect of the invention.

The invention also relates to a compound of the invention against TNF that comprises at least one (such as one, two or three) of the Nanobodies of the invention of SEQ ID NO's: 320 to 333. Such compounds of the invention against TNF may again be as further described herein, and thus for example may comprise suitable linkers, may comprise a C-terminal extension as described herein, and may be half-life extended (for example because they comprise a Nanobody against human serum albumin, such as (preferably) a Nanobody of the invention against human serum albumin). Reference is made to Table W below. Generally, as TNF is a multivalent target, compounds of the invention comprising two or three anti-TNF ISV's (and linkers of suitable length, see WO 06/122786) are preferred) Some specifically preferred examples of compounds of the invention against TNF are given in FIG. 27 as SEQ ID NO's: 640 to 675; and each of these compounds form a further aspect of the invention. Thus, in another aspect, the invention relates to a polypeptide that is directed against TNF and that has an amino acid sequence that is chosen from the group consisting of SEQ ID NO's: 640 to 675. More generally, compounds of the invention against TNF may be as described in WO 2006/122786, but comprising ISV's of the invention. They may also be used for the purposes described in WO 2006/122786.

TABLE W

Examples of compounds of the invention against TNF.

| Polypeptide/ construct(1) | General formula | ISV building blocks and linkers |
|---|---|---|
| Monovalent | [TNF] | [TNF] = one of SEQ ID NO's: 464 to 477 and/or 482 to 495 |
| Monovalent/ C-terminal extension | [TNF]-X(n) | [TNF] = one of SEQ ID NO's: 464 to 477 and/or 482 to 495 |
| Monovalent/ half-life extended | [TNF]-$L_1$-[SA]<br>[SA]-$L_1$-[TNF] | [TNF] = one of SEQ ID NO's: 464 to 477 and/or 482 to 495<br>[SA] = (see legend below)<br>$L_1$ = (see legend below) |
| Monovalent/ half-life extended/ C-terminal extension | [TNF]-$L_1$-[SA]-X(n)<br>[SA]-$L_1$-[TNF]-X(n) | [TNF] = one of SEQ ID NO's: 464 to 477 and/or 482 to 495<br>[SA] = (see legend below)<br>$L_1$ = (see legend below)<br>X(n) = (see legend below) |
| Bivalent(2) | [TNF]-$L_1$-[TNF] | At least one [TNF] present is = one of SEQ ID NO's: 464 to 477 and/or 482 to 495 (4)<br>$L_1$ = (see legend below) |
| Bivalent/ C-terminal extension(2) | [TNF]-$L_1$-[TNF]-X(n) | At least one [TNF] = one of SEQ ID NO's: 464 to 477 and/or 482 to 495 (4)<br>$L_1$ = (see legend below) |

TABLE W-continued

| Examples of compounds of the invention against TNF. | | |
|---|---|---|
| Polypeptide/ construct(1) | General formula | ISV building blocks and linkers |
| | | X(n) = (see legend below) |
| Bivalent/ half-life extended(2) | [TNF]-$L_1$-[TNF]-$L_2$-[SA]<br>[TNF]-$L_1$-[SA]-$L_2$-[TNF]<br>[SA]-$L_1$-[TNF]-$L_2$-[TNF] | At least one [TNF] present is = one of SEQ ID NO's: 464 to 477 and/or 482 to 495 (4)<br>[SA] = (see legend below)<br>$L_1$ = (see legend below)<br>$L_2$ = (see legend below) |
| Bivalent/ half-life extended/ C-terminal extension(2) | [TNF]-$L_1$-[TNF]-$L_2$-[SA]-X(n)<br>[TNF]-$L_1$-[SA]-$L_2$-[TNF]-X(n)<br>[SA]-$L_1$-[TNF]-$L_2$-[TNF]-X(n) | At least one [TNF] present is = one of SEQ ID NO's: 464 to 477 and/or 482 to 495 (4)<br>[SA] = (see legend below)<br>$L_1$ = (see legend below)<br>$L_2$ = (see legend below)<br>X(n) = (see legend below) |
| Bispecific (3) | [TNF]-$L_1$-[Nb]<br>[Nb]-$L_1$-[TNF]<br>[TNF]-$L_1$-[TNF]-$L_2$-[Nb]<br>[TNF]-$L_1$-[Nb]-$L_2$-[TNF]<br>[Nb]-$L_1$-[TNF]-$L_2$-[TNF] | At least one [TNF] present is = one of SEQ ID NO's: 464 to 477 and/or 482 to 495 (4)<br>$L_1$ = (see legend below)<br>$L_2$ = (see legend below)<br>[Nb] = (see legend below) |
| Bispecific/ C-terminal extension (3) | [TNF]-$L_1$-[Nb]-X(n)<br>[Nb]-$L_1$-[TNF]-X(n)<br>[TNF]-$L_1$-[TNF]-$L_2$-[Nb]-X(n)<br>[TNF]-$L_1$-[Nb]-$L_2$-[TNF]-X(n)<br>[Nb]-$L_1$-[TNF]-$L_2$-[TNF]-X(n) | At least one [TNF] present is = one of SEQ ID NO's: 464 to 477 and/or 482 to 495 (4)<br>$L_1$ = (see legend below)<br>$L_2$ = (see legend below)<br>X(n) = (see legend below)<br>[Nb] = (see legend below) |
| Bispecific/ half-life extended (3) | [TNF]-$L_1$-[Nb]-$L_2$-[SA]<br>[TNF]-$L_1$-[SA]-$L_2$-[Nb]<br>[Nb]-$L_1$-[SA]-$L_2$-[TNF]<br>[Nb]-$L_1$-[TNF]-$L_2$-[SA]<br>[SA]-$L_1$-[TNF]-$L_2$-[Nb]<br>[SA]-$L_1$-[Nb]-$L_2$-[TNF] | At least one [TNF] present is = one of SEQ ID NO's: 464 to 477 and/or 482 to 495 (4)<br>[SA] = (see legend below)<br>$L_1$, $L_2$, $L_3$(see legend below)<br>[Nb] = (see legend below) |
| Bispecific/ half-life extended (3) | [TNF]-$L_1$-[TNF]-$L_2$-[Nb]-$L_3$-[SA]<br>[Nb]-$L_1$-[TNF]-$L_2$-[TNF]-$L_3$-[SA]<br>[SA]-$L_1$-[TNF]-$L_2$-[TNF]-$L_3$-[Nb]<br>[SA]-$L_1$-[TNF]-$L_2$-[Nb]-$L_3$-[TNF]<br>[TNF]-$L_1$-[Nb]-$L_2$-[TNF]-$L_3$-[SA] | At least one [TNF] present is = one of SEQ ID NO's: 464 to 477 and/or 482 to 495 (4)<br>[SA] = (see legend below)<br>$L_1$, $L_2$, $L_3$(see legend below)<br>[Nb] = (see legend below) |
| Bispecific/ half-life extended/ C-terminal extension (3) | [TNF]-$L_1$-[Nb]-$L_2$-[SA]-X(n)<br>[TNF]-$L_1$-[SA]-$L_2$-[Nb]-X(n)<br>[Nb]-$L_1$-[SA]-$L_2$-[TNF]-X(n)<br>[Nb]-$L_1$-[TNF]-$L_2$-[SA]-X(n)<br>[SA]-$L_1$-[TNF]-$L_2$-[Nb]-X(n)<br>[SA]-$L_1$-[Nb]-$L_2$-[TNF]-X(n)<br>[TNF]-$L_1$-[TNF]-$L_2$-[Nb]-$L_3$-[SA]-X(n)<br>[Nb]-$L_1$-[TNF]-$L_2$-[TNF]-$L_3$-[SA]-X(n)<br>[SA]-$L_1$-[TNF]-$L_2$-[TNF]-$L_3$-[Nb]-X(n)<br>[SA]-$L_1$-[TNF]-$L_2$-[Nb]-$L_3$-[TNF]-X(n)<br>[TNF]-$L_1$-[Nb]-$L_2$-[TNF]-$L_3$-[SA]-X(n) | At least one [TNF] present is = one of SEQ ID NO's: 464 to 477 and/or 482 to 495 (4)<br>[SA] = (see legend below)<br>$L_1$, $L_2$, $L_3$(see legend below)<br>X(n) = (see legend below)<br>[Nb] = (see legend below) |

Legend:

[SA] is an ISV against (human) serum albumin, preferably an ISV of the invention against (human) serum albumin, more preferably one of SEQ ID NO's: 46 or 61 or even more preferably one of the ISVD's of the invention of SEQ ID NO's: 47, 54, 62, 69, 78, 86, 109, 116, 123, 130 or 496 to 513.

Each of $L_1$, $L_2$ and $L_3$ is (independently) a suitable linker. Each of $L_1$, $L_2$ and $L_3$ may (independently) be present or not. Non-limiting examples of suitable linkers are the gly-ser linkers referred to herein, such as the 9GS, 30GS or 35GS linker.

X(n) = a C-terminal extension as a C-terminal extension as described in herein and/or in WO 12/175741

[Nb] is an ISV against another therapeutic target.

Notes:

(1)In this Table:

"Monovalent" generally refers to polypeptides/constructs comprising a single ISV against TNF. These may further comprise a half-life extending ISV (such as an ISV against serum albumin).

"Bivalent" generally refers to polypeptides/constructs comprising two ISV's against TNF (which may be the same or different). These may again further comprise a half-life extending ISV (such as an ISV against serum albumin).

"Bispecific" generally refers to polypeptides/constructs comprising at least one (such as 1 or 2) ISV's against TNF and at least one (such as 1 or 2) other ISV against a therapeutic target. These may further comprise a half-life extending ISV (such as an ISV against serum albumin).

In the polypeptides/constructs described in this table, at least one of the ISV's against TNF present is an ISV of the invention, and preferably all of the ISV's against TNF present in such polypeptide/construct are ISV's of the invention. Also, when a half-life extending ISV and/or an ISV against another therapeutic target is present in such polypeptide/construct, each of these (and preferably all of these) may also be (and preferably are) ISV's of the invention (2)All "bivalent" constructs in this Table may also be biparatopic, meaning that they comprise at least two (such as two) ISV's against TNF, which are directed against different epitopes on TNF.

(3) As will be clear to the skilled person, other/further bispecific constructs than those listed can be made using the building blocks and linkers mentioned.

(4) Preferably, each [TNF] present is independently chosen from SEQ ID NO's: 464 to 477 and/or 482 to 495. Also, the [TNF] present may be the same or different; in a biparatopic polypeptide/construct they will be directed against different epitopes on TNF.

(5) Each of the polypeptides/constructs mentioned to in this column by means of reference to a SEQ ID forms an individual specific aspect of the invention.

Example 14: Further VH Domains (and in Particular Nanobodies) Against TNF, and Compounds of the Invention Comprising the Same In one specific aspect, the VH domains of the invention (and in particular ISVDs of the invention and more in particular Nanobodies of the invention) and compounds of the invention may be directed against TNF.

Such a VH domain of the invention against TNF will generally comprise: (i) suitable framework sequences that suitably comprise the amino acid residues/mutations of the invention as described herein; as well as (ii) CDR sequences that allow the VH domain of the invention to specifically bind to TNF. In addition, such a VH domain of the invention against TNF may also suitably have a C-terminal extension as described herein, in particular when said VH domain is monovalent or forms the C-terminal end of the compound of the invention in which said VH domain is present (again, as further described herein). Such VH domains of the invention against TNF may further be as further described herein, and may in particular be ISVD's.

Again, as with other aspects and embodiments of the invention described herein, when a specific ISVD (such as the ISVD against TNF described in this Example) or compound comprising the same is said to be "according to the invention" or "as further described herein", the preferred aspects/embodiments and preferences that are generally described herein for the ISVD's or compounds of the invention also specifically apply to said specific ISVD or compound, respectively, unless explicitly indicated otherwise or unless the specific technical context requires otherwise.

Thus, in a particular aspect, the present invention relates to a VH domain (and in particular an ISVD) that is directed against TNF, in which (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). In particular, in such VH domains against TNF:

- the amino acid residue at position 11 is preferably chosen from L, V or K (and is most preferably V); and
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v).

The VH domains of the invention against TNF may further be as described herein and may again in particular be an ISVD (and more in particular a Nanobody) against TNF or a protein, polypeptide or other compound or construct that comprises as least one such ISVD. Such a protein, polypeptide or other compound or construct may also be as further described herein, and may for example have an increased half-life (i.e. as described herein, e.g. a half-life—expressed as t1/2 beta—in human subjects of in human subjects of at least 1 day, preferably at least 3 days, more preferably at least 7 days, such as at least 10 days), and for this purpose may for example comprise a serum-albumin binding Nanobody, which may also be a serum-albumin binding Nanobody of the invention (again, as described herein).

Also, such an ISVD may suitably have a C-terminal extension (as further described herein and in WO 12/175741), in particular when said ISVD forms the C-terminal end of a protein, polypeptide or other compound or construct comprising the same (again, as further described herein).

In one preferred aspect, the VH domains of the invention against TNF comprise (i) a CDR1 sequence that is the sequence of SEQ ID NO: 335 (which is preferred) or that is an amino acid sequence that has only one amino acid difference with the sequence of SEQ ID NO: 335; (ii) a CDR2 sequence that is the sequence of SEQ ID NO: 336 (which is preferred) or that is an amino acid sequence that has only one or two amino acid differences with the sequence of SEQ ID NO: 336; and (iii) a CDR3 sequence that is the sequence of SEQ ID NO: 337 (which is preferred) or that is an amino acid sequence that has only one or two amino acid differences with the sequence of SEQ ID NO: 337.

More preferably, in a VH domain of the invention against TNF according to this aspect: (i) CDR1 is SEQ ID NO: 335; (ii) CDR2 is SEQ ID NO: 336; and (iii) CDR3 is SEQ ID NO: 337.

In one specific aspect, a Nanobody of the invention against TNF is a variant of the Nanobody of SEQ ID NO: 334 (with at least 90% sequence identity, such as at least 95% sequence identity, with SEQ ID NO: 334), in which:

- the amino acid residue at position 11 is preferably chosen from L, V or K (and is most
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). The CDR's of such an ISV are preferably as defined in the preceding two paragraphs.

Some specifically preferred, but non-limiting examples of Nanobodies of the invention against TNF are listed in FIG. 17B as SEQ ID NO's: 338 to 351; and each of these Nanobodies form a further aspect of the invention.

The invention also relates to a compound of the invention against TNF that comprises at least one (such as one, two or three) of the Nanobodies of the invention of SEQ ID NO's: 338 to 251. Such compounds of the invention against TNF may again be as further described herein, and thus for example may comprise suitable linkers, may comprise a C-terminal extension as described herein, and may be half-life extended (for example because they comprise a Nanobody against human serum albumin, such as (preferably) a Nanobody of the invention against human serum albumin).

Reference is made to Table X below. Generally, as TNF is a multivalent target, compounds of the invention comprising two or three anti-TNF ISV's are preferred.

TABLE X

Examples of compounds of the invention against TNF.

| Polypeptide/ construct([1]) | General formula | ISV building blocks and linkers |
|---|---|---|
| Monovalent | [TNF] | [TNF] = one of SEQ ID NO's: 464 to 477 and/or 482 to 495 |
| Monovalent/ C-terminal extension | [TNF]-X(n) | [TNF] = one of SEQ ID NO's: 464 to 477 and/or 482 to 495 |
| Monovalent/ half-life extended | [TNF]-$L_1$-[SA]<br>[SA]-$L_1$-[TNF] | [TNF] = one of SEQ ID NO's: 464 to 477 and/or 482 to 495<br>[SA] = (see legend below)<br>$L_1$ = (see legend below) |
| Monovalent/ half-life extended/ C-terminal extension | [TNF]-$L_1$-[SA]-X(n)<br>[SA]-$L_1$-[TNF]-X(n) | [TNF] = one of SEQ ID NO's: 464 to 477 and/or 482 to 495<br>[SA] = (see legend below)<br>$L_1$ = (see legend below)<br>X(n) = (see legend below) |
| Bivalent([2]) | [TNF]-$L_1$-[TNF] | At least one [TNF] present is = one of SEQ ID NO's: 464 to 477 and/or 482 to 495 ([4])<br>$L_1$ = (see legend below) |
| Bivalent/ C-terminal extension([2]) | [TNF]-$L_1$-[TNF]-X(n) | At least one [TNF] = one of SEQ ID NO's: 464 to 477 and/or 482 to 495 ([4])<br>$L_1$ = (see legend below)<br>X(n) = (see legend below) |
| Bivalent/ half-life extended([2]) | [TNF]-$L_1$-[TNF]-$L_2$-[SA]<br>[TNF]-$L_1$-[SA]-$L_2$-[TNF]<br>[SA]-$L_1$-[TNF]-$L_2$-[TNF] | At least one [TNF] present is = one of SEQ ID NO's: 464 to 477 and/or 482 to 495 ([4])<br>[SA] = (see legend below)<br>$L_1$ = (see legend below)<br>$L_2$ = (see legend below) |
| Bivalent/ half-life extended/ C-terminal extension([2]) | [TNF]-$L_1$-[TNF]-$L_2$-[SA]-X(n)<br>[TNF]-$L_1$-[SA]-$L_2$-[TNF]-X(n)<br>[SA]-$L_1$-[TNF]-$L_2$-[TNF]-X(n) | At least one [TNF] present is = one of SEQ ID NO's: 464 to 477 and/or 482 to 495 ([4])<br>[SA] = (see legend below)<br>$L_1$ = (see legend below)<br>$L_2$ = (see legend below)<br>X(n) = (see legend below) |
| Bispecific ([3]) | [TNF]-$L_1$-[Nb]<br>[Nb]-$L_1$-[TNF]<br>[TNF]-$L_1$-[TNF]-$L_2$-[Nb]<br>[TNF]-$L_1$-[Nb]-$L_2$-[TNF]<br>[Nb]-$L_1$-[TNF]-$L_2$-[TNF] | At least one [TNF] present is = one of SEQ ID NO's: 464 to 477 and/or 482 to 495 ([4])<br>$L_1$ = (see legend below)<br>$L_2$ = (see legend below)<br>[Nb] = (see legend below) |
| Bispecific/ C-terminal extension ([3]) | [TNF]-$L_1$-[Nb]-X(n)<br>[Nb]-$L_1$-[TNF]-X(n)<br>[TNF]-$L_1$-[TNF]-$L_2$-[Nb]-X(n)<br>[TNF]-$L_1$-[Nb]-$L_2$-[TNF]-X(n)<br>[Nb]-$L_1$-[TNF]-$L_2$-[TNF]-X(n) | At least one [TNF] present is = one of SEQ ID NO's: 464 to 477 and/or 482 to 495 ([4])<br>$L_1$ = (see legend below)<br>$L_2$ = (see legend below)<br>X(n) = (see legend below)<br>[Nb] = (see legend below) |
| Bispecific/ half-life extended ([3]) | [TNF]-$L_1$-[Nb]-$L_2$-[SA]<br>[TNF]-$L_1$-[SA]-$L_2$-[Nb]<br>[Nb]-$L_1$-[SA]-$L_2$-[TNF]<br>[Nb]-$L_1$-[TNF]-$L_2$-[SA]<br>[SA]-$L_1$-[TNF]-$L_2$-[Nb]<br>[SA]-$L_1$-[Nb]-$L_2$-[TNF] | At least one [TNF] present is = one of SEQ ID NO's: 464 to 477 and/or 482 to 495 ([4])<br>[SA] = (see legend below)<br>$L_1$, $L_2$, $L_3$(see legend below)<br>[Nb] = (see legend below) |
| Bispecific/ half-life extended ([3]) | [TNF]-$L_1$-[TNF]-$L_2$-[Nb]-$L_3$-[SA]<br>[Nb]-$L_1$-[TNF]-$L_2$-[TNF]-$L_3$-[SA]<br>[SA]-$L_1$-[TNF]-$L_2$-[TNF]-$L_3$-[Nb]<br>[SA]-$L_1$-[TNF]-$L_2$-[Nb]-$L_3$-[TNF]<br>[TNF]-$L_1$-[Nb]-$L_2$-[TNF]-$L_3$-[SA] | At least one [TNF] present is = one of SEQ ID NO's: 464 to 477 and/or 482 to 495 ([4])<br>[SA] = (see legend below)<br>$L_1$, $L_2$, $L_3$(see legend below)<br>[Nb] = (see legend below) |

TABLE X-continued

Examples of compounds of the invention against TNF.

| Polypeptide/ construct(1) | General formula | ISV building blocks and linkers |
|---|---|---|
| Bispecific/ half-life extended/ C-terminal extension (3) | [TNF]-$L_1$-[Nb]-$L_2$-[SA]-X(n)<br>[TNF]-$L_1$-[SA]-$L_2$-[Nb]-X(n)<br>[Nb]-$L_1$-[SA]-$L_2$-[TNF]-X(n)<br>[Nb]-$L_1$-[TNF]-$L_2$-[SA]-X(n)<br>[SA]-$L_1$-[TNF]-$L_2$-[Nb]-X(n)<br>[SA]-$L_1$-[Nb]-$L_2$-[TNF]-X(n)<br>[TNF]-$L_1$-[TNF]-$L_2$-[Nb]-$L_3$-[SA]-X(n)<br>[Nb]-$L_1$-[TNF]-$L_2$-[TNF]-$L_3$-[SA]-X(n)<br>[SA]-$L_1$-[TNF]-$L_2$-[TNF]-$L_3$-[Nb]-X(n)<br>[SA]-$L_1$-[TNF]-$L_2$-[Nb]-$L_3$-[TNF]-X(n)<br>[TNF]-$L_1$-[Nb]-$L_2$-[TNF]-$L_3$-[SA]-X(n) | At least one [TNF] present is = one of SEQ ID NO's: 464 to 477 and/or 482 to 495 (4)<br>[SA] = (see legend below)<br>$L_1$, $L_2$, $L_3$(see legend below)<br>X(n) = (see legend below)<br>[Nb] = (see legend below) |

Legend:

[SA] is an ISV against (human) serum albumin, preferably an ISV of the invention against (human) serum albumin, more preferably one of SEQ ID NO's: 46 or 61 or even more preferably one of the ISVD's of the invention of SEQ ID NO's: 47, 54, 62, 69, 78, 86, 109, 116, 123, 130 or 496 to 513.

Each of $L_1$, $L_2$ and $L_3$ is (independently) a suitable linker. Each of $L_1$, $L_2$ and $L_3$ may (independently) be present or not. Non-limiting examples of suitable linkers are the gly-ser linkers referred to herein, such as the 9GS, 30GS or 35GS linker.

X(n) = a C-terminal extension as a C-terminal extension as described in herein and/or in WO 12/175741

[Nb] is an ISV against another therapeutic target.

Notes:

(1)In this Table:

"Monovalent" generally refers to polypeptides/constructs comprising a single ISV against TNF. These may further comprise a half-life extending ISV (such as an ISV against serum albumin).

"Bivalent" generally refers to polypeptides/constructs comprising two ISV's against TNF (which may be the same or different). These may again further comprise a half-life extending ISV (such as an ISV against serum albumin).

"Bispecific" generally refers to polypeptides/constructs comprising at least one (such as 1 or 2) ISV's against TNF and at least one (such as 1 or 2) other ISV against a therapeutic target. These may further comprise a half-life extending ISV (such as an ISV against serum albumin).

In the polypeptides/constructs described in this table, at least one of the ISV's against TNF present is an ISV of the invention, and preferably all of the ISV's against TNF present in such polypeptide/construct are ISV's of the invention. Also, when a half-life extending ISV and/or an ISV against another therapeutic target is present in such polypeptide/construct, each of these (and preferably all of these) may also be (and preferably are) ISV's of the invention (2)All "bivalent" constructs in this Table may also be biparatopic, meaning that they comprise at least two (such as two) ISV's against TNF, which are directed against different epitopes on TNF.

(3) As will be clear to the skilled person, other/further bispecific constructs than those listed can be made using the building blocks and linkers mentioned.

(4) Preferably, each [TNF] present is independently chosen from SEQ ID NO's: 464 to 477 and/or 482 to 495. Also, the [TNF] present may be the same or different; in a biparatopic polypeptide/construct they will be directed against different epitopes on TNF.

(5) Each of the polypeptides/constructs mentioned to in this column by means of reference to a SEQ ID forms an individual specific aspect of the invention.

Example 15: VH Domains (and in Particular Nanobodies) Against c-Met, and Compounds of the Invention Comprising the Same In one specific aspect, the VH domains of the invention (and in particular ISVDs of the invention and more in particular Nanobodies of the invention) and compounds of the invention may be directed against c-Met.

Such a VH domain of the invention against c-Met will generally comprise: (i) suitable framework sequences that suitably comprise the amino acid residues/mutations of the invention as described herein; as well as (ii) CDR sequences that allow the VH domain of the invention to specifically bind to c-Met. In addition, such a VH domain of the invention against c-Met may also suitably have a C-terminal extension as described herein, in particular when said VH domain is monovalent or forms the C-terminal end of the compound of the invention in which said VH domain is present (again, as further described herein). Such VH domains of the invention against c-Met may further be as further described herein, and may in particular be ISVD's.

Again, as with other aspects and embodiments of the invention described herein, when a specific ISVD (such as the ISVD against c-Met described in this Example) or compound comprising the same is said to be "according to the invention" or "as further described herein", the preferred aspects/embodiments and preferences that are generally described herein for the ISVD's or compounds of the invention also specifically apply to said specific ISVD or compound, respectively, unless explicitly indicated otherwise or unless the specific technical context requires otherwise.

Thus, in a particular aspect, the present invention relates to a VH domain (and in particular an ISVD) that is directed against c-Met, in which (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). In particular, in such VH domains against c-Met:

- the amino acid residue at position 11 is preferably chosen from L, V or K (and is most preferably V); and
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v).

The VH domains of the invention against c-Met may further be as described herein and may again in particular be an ISVD (and more in particular a Nanobody) against c-Met or a protein, polypeptide or other compound or construct that comprises as least one such ISVD. Such a protein, polypeptide or other compound or construct may also be as further described herein, and may for example have an increased half-life (i.e. as described herein, e.g. a half-life—expressed as t1/2 beta—in human subjects of in human subjects of at least 1 day, preferably at least 3 days, more preferably at least 7 days, such as at least 10 days), and for this purpose may for example comprise a serum-albumin binding Nanobody, which may also be a serum-albumin binding Nanobody of the invention (again, as described herein).

Also, such an ISVD may suitably have a C-terminal extension (as further described herein and in WO 12/175741), in particular when said ISVD forms the C-terminal end of a protein, polypeptide or other compound or construct comprising the same (again, as further described herein).

In one preferred aspect, the VH domains of the invention against c-Met comprise (i) a CDR1 sequence that is the sequence of SEQ ID NO: 353 (which is preferred) or that is an amino acid sequence that has only one amino acid difference with the sequence of SEQ ID NO: 353; (ii) a CDR2 sequence that is the sequence of SEQ ID NO: 354 (which is preferred) or that is an amino acid sequence that has only one or two amino acid differences with the sequence of SEQ ID NO: 354; and (iii) a CDR3 sequence that is the sequence of SEQ ID NO: 355 (which is preferred) or that is an amino acid sequence that has only one or two amino acid differences with the sequence of SEQ ID NO: 355.

More preferably, in a VH domain of the invention against c-Met according to this aspect: (i) CDR1 is SEQ ID NO: 353; (ii) CDR2 is SEQ ID NO: 354; and (iii) CDR3 is SEQ ID NO: 355.

In one specific aspect, a Nanobody of the invention against c-Met is a variant of the Nanobody of SEQ ID NO: 352 (with at least 90% sequence identity, such as at least 95% sequence identity, with SEQ ID NO: 352), in which:

- the amino acid residue at position 11 is preferably chosen from L, V or K (and is most
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). The CDR's of such an ISV are preferably as defined in the preceding two paragraphs.

In another preferred aspect, the VH domains of the invention against c-Met comprise (i) a CDR1 sequence that is the sequence of SEQ ID NO: 371 (which is preferred) or that is an amino acid sequence that has only one amino acid difference with the sequence of SEQ ID NO: 371; (ii) a CDR2 sequence that is the sequence of SEQ ID NO: 372 (which is preferred) or that is an amino acid sequence that has only one or two amino acid differences with the sequence of SEQ ID NO: 372; and (iii) a CDR3 sequence that is the sequence of SEQ ID NO: 373 (which is preferred) or that is an amino acid sequence that has only one or two amino acid differences with the sequence of SEQ ID NO: 373.

More preferably, in such a VH domain of the invention against c-Met according to this aspect: (i) CDR1 is SEQ ID NO: 371; (ii) CDR2 is SEQ ID NO: 372; and (iii) CDR3 is SEQ ID NO: 373.

In one specific aspect, a Nanobody of the invention against c-Met is a variant of the Nanobody of SEQ ID NO: 370 (with at least 90% sequence identity, such as at least 95% sequence identity, with SEQ ID NO: 370), in which:

- the amino acid residue at position 11 is preferably chosen from L, V or K (and is most preferably V); and
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q:

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). Again, the CDR's of such an ISV are preferably as defined in the preceding two paragraphs.

Some specifically preferred, but non-limiting examples of Nanobodies of the invention against c-Met are listed in FIG. 18A as SEQ ID NO's: 356 to 369 and in FIG. 18B as SEQ ID NO's: 374 to 387, respectively; and each of these Nanobodies form a further aspect of the invention.

The invention also relates to a compound of the invention against c-Met that comprises at least one (such as one, two or three) of the Nanobodies of the invention of SEQ ID NO's: 356 to 369 and/or 374 to 387. Such compounds of the invention against c-Met may again be as further described herein, and thus for example may comprise suitable linkers, may comprise a C-terminal extension as described herein, and may be half-life extended (for example because they comprise a Nanobody against human serum albumin, such as (preferably) a Nanobody of the invention against human serum albumin). Reference is made to Table Y below.

As described in for example WO 2013/045707, one particularly preferred class of Nanobody-based compounds against c-Met are biparatopic compounds. Thus, in one aspect of the invention, a compound of the invention against c-Met is a biparatopic construct that comprises one ISV that is either SEQ ID NO: 352 or (preferably) an ISV of the invention that has been derived from SEQ ID NO: 352 (as described in this Example 15) and one ISV that is either SEQ ID NO: 370 or (preferably) an ISV of the invention that has been derived from SEQ ID NO: 370 (as described in this Example 15), provided that at least one (and preferably both) of these ISV's are ISV's of the invention. Such biparatopic constructs may also be half-life extended (i.e. by means of a serum albumin-binding ISV). Some specific examples of such biparatopic constructs are given in SEQ ID NO: 676 to 693. Also, bispecific constructs against c-Met may also comprise an ISV against VEGF or EGFR. Reference is again made to WO 2014/341309.

Some specifically preferred examples of compounds of the invention against c-Met are given in FIGS. 28A and 28B SEQ ID NO's: 676 to 694; and each of these compounds form a further aspect of the invention. Thus, in another aspect, the invention relates to a polypeptide that is directed against c-Met and that has an amino acid sequence that is chosen from the group consisting of SEQ ID NO's: 676 to 694. More generally, compounds of the invention against c-Met may be as described in WO 2013/045707, but comprising ISV's of the invention. They may also be used for the purposes described in WO 2013/045707.

TABLE Y

Examples of compounds of the invention against c-Met.

| Polypeptide/ construct(1) | General formula | ISV building blocks and linkers |
|---|---|---|
| Monovalent | [c-Met] | [c-Met] = one of SEQ ID NO's: 464 to 477 and/or 482 to 495 |
| Monovalent/ C-terminal extension | [c-Met]-X(n) | [c-Met] = one of SEQ ID NO's: 464 to 477 and/or 482 to 495 |
| Monovalent/ half-life extended | [c-Met]-$L_1$-[SA]<br>[SA]-$L_1$-[c-Met] | [c-Met] = one of SEQ ID NO's: 464 to 477 and/or 482 to 495<br>[SA] = (see legend below)<br>$L_1$ = (see legend below) |
| Monovalent/ half-life extended/C-terminal extension | [c-Met]-$L_1$-[SA]-X(n)<br>[SA]-$L_1$-[c-Met]-X(n) | [c-Met] = one of SEQ ID NO's: 464 to 477 and/or 482 to 495<br>[SA] = (see legend below)<br>$L_1$ = (see legend below)<br>X(n) = (see legend below) |
| Bivalent(2) | [c-Met]-$L_1$-[c-Met] | At least one [c-Met] present is = one of SEQ ID NO's: 464 to 477 and/or 482 to 495 (4)<br>$L_1$ = (see legend below) |
| Bivalent/ C-terminal extension(2) | [c-Met]-$L_1$-[c-Met]-X(n) | At least one [c-Met] = one of SEQ ID NO's: 464 to 477 and/or 482 to 495 (4)<br>$L_1$ = (see legend below)<br>X(n) = (see legend below) |
| Bivalent/ half-life extended(2) | [c-Met]-$L_1$-[c-Met]-$L_2$-[SA]<br>[c-Met]-$L_1$-[SA]-$L_2$-[c-Met]<br>[SA]-$L_1$-[c-Met]-$L_2$-[c-Met] | At least one [c-Met] present is = one of SEQ ID NO's: 464 to 477 and/or 482 to 495 (4)<br>[SA] = (see legend below)<br>$L_1$ = (see legend below)<br>$L_2$ = (see legend below) |
| Bivalent/ half-life extended/ C-terminal extension(2) | [c-Met]-$L_1$-[c-Met]-$L_2$-[SA]-X(n)<br>[c-Met]-$L_1$-[SA]-$L_2$-[c-Met]-X(n)<br>[SA]-$L_1$-[c-Met]-$L_2$-[c-Met]-X(n) | At least one [c-Met] present is = one of SEQ ID NO's: 464 to 477 and/or 482 to 495 (4)<br>[SA] = (see legend below)<br>$L_1$ = (see legend below)<br>$L_2$ = (see legend below)<br>X(n) = (see legend below) |
| Bispecific (3) | [c-Met]-$L_1$-[Nb]<br>[Nb]-$L_1$-[c-Met]<br>[c-Met]-$L_1$-[c-Met]-$L_2$-[Nb]<br>[c-Met]-$L_1$-[Nb]-$L_2$-[c-Met]<br>[Nb]-$L_1$-[c-Met]-$L_2$-[c-Met] | At least one [c-Met] present is = one of SEQ ID NO's: 464 to 477 and/or 482 to 495 (4)<br>$L_1$ = (see legend below)<br>$L_2$ = (see legend below)<br>[Nb] = (see legend below) |
| Bispecific/ C-terminal extension (3) | [c-Met]-$L_1$-[Nb]-X(n)<br>[Nb]-$L_1$-[c-Met]-X(n)<br>[c-Met]-$L_1$-[c-Met]-$L_2$-[Nb]-X(n)<br>[c-Met]-$L_1$-[Nb]-$L_2$-[c-Met]-X(n)<br>[Nb]-$L_1$-[c-Met]-$L_2$-[c-Met]-X(n) | At least one [c-Met] present is = one of SEQ ID NO's: 464 to 477 and/or 482 to 495 (4)<br>$L_1$ = (see legend below)<br>$L_2$ = (see legend below)<br>X(n) = (see legend below)<br>[Nb] = (see legend below) |
| Bispecific/ half-life extended (3) | [c-Met]-$L_1$-[Nb]-$L_2$-[SA]<br>[c-Met]-$L_1$-[SA]-$L_2$-[Nb]<br>[Nb]-$L_1$-[SA]-$L_2$-[c-Met]<br>[Nb]-$L_1$-[c-Met]-$L_2$-[SA]<br>[SA]-$L_1$-[c-Met]-$L_2$-[Nb]<br>[SA]-$L_1$-[Nb]-$L_2$-[c-Met] | At least one [c-Met] present is = one of SEQ ID NO's: 464 to 477 and/or 482 to 495 (4)<br>[SA] = (see legend below)<br>$L_1$, $L_2$, $L_3$(see legend below)<br>[Nb] = (see legend below) |
| Bispecific/ half-life extended (3) | [c-Met]-$L_1$-[c-Met]-$L_2$-[Nb]-$L_3$-[SA]<br>[Nb]-$L_1$-[c-Met]-$L_2$-[c-Met]-$L_3$-[SA]<br>[SA]-$L_1$-[c-Met]-$L_2$-[c-Met]-$L_3$-[Nb]<br>[SA]-$L_1$-[c-Met]-$L_2$-[Nb]-$L_3$-[c-Met]<br>[c-Met]-$L_1$-[Nb]-$L_2$-[c-Met]-$L_3$-[SA] | At least one [c-Met] present is = one of SEQ ID NO's: 464 to 477 and/or 482 to 495 (4)<br>[SA] = (see legend below)<br>$L_1$, $L_2$, $L_3$(see legend below)<br>[Nb] = (see legend below) |

TABLE Y-continued

Examples of compounds of the invention against c-Met.

| Polypeptide/ construct([1]) | General formula | ISV building blocks and linkers |
|---|---|---|
| Bispecific/ half-life extended/ C-terminal extension ([3]) | [c-Met]-$L_1$-[Nb]-$L_2$-[SA]-X(n)<br>[c-Met]-$L_1$-[SA]-$L_2$-[Nb]-X(n)<br>[Nb]-$L_1$-[SA]-$L_2$-[c-Met]-X(n)<br>[Nb]-$L_1$-[c-Met]-$L_2$-[SA]-X(n)<br>[SA]-$L_1$-[c-Met]-$L_2$-[Nb]-X(n)<br>[SA]-$L_1$-[Nb]-$L_2$-[c-Met]-X(n)<br>[c-Met]-$L_1$-[c-Met]-$L_2$-[Nb]-$L_3$-[SA]-X(n)<br>[Nb]-$L_1$-[c-Met]-$L_2$-[c-Met]-$L_3$-[SA]-X(n)<br>[SA]-$L_1$-[c-Met]-$L_2$-[c-Met]-$L_3$-[Nb]-X(n)<br>[SA]-$L_1$-[c-Met]-$L_2$-[Nb]-$L_3$-[c-Met]-X(n)<br>[c-Met]-$L_1$-[Nb]-$L_2$-[c-Met]-$L_3$-[SA]-X(n) | At least one [c-Met] present is = one of SEQ ID NO's: 464 to 477 and/or 482 to 495 ([4])<br>[SA] = (see legend below)<br>$L_1$, $L_2$, $L_3$(see legend below)<br>X(n) = (see legend below)<br>[Nb] = (see legend below) |

Legend:

[SA] is an ISV against (human) serum albumin, preferably an ISV of the invention against (human) serum albumin, more preferably one of SEQ ID NO's: 46 or 61 or even more preferably one of the ISVD's of the invention of SEQ ID NO's: 47, 54, 62, 69, 78, 86, 109, 116, 123, 130 or 496 to 513.

Each of $L_1$, $L_2$ and $L_3$ is (independently) a suitable linker. Each of $L_1$, $L_2$ and $L_3$ may (independently) be present or not. Non-limiting examples of suitable linkers are the gly-ser linkers referred to herein, such as the 9GS, 30GS or 35GS linker.

X(n) = a C-terminal extension as a C-terminal extension as described in herein and/or in WO 12/175741

[Nb] is an ISV against another therapeutic target.

Notes:

([1])In this Table:

"Monovalent" generally refers to polypeptides/constructs comprising a single ISV against c-Met. These may further comprise a half-life extending ISV (such as an ISV against serum albumin).

"Bivalent" generally refers to polypeptides/constructs comprising two ISV's against c-Met (which may be the same or different). These may again further comprise a half-life extending ISV (such as an ISV against serum albumin).

"Bispecific" generally refers to polypeptides/constructs comprising at least one (such as 1 or 2) ISV's against c-Met and at least one (such as 1 or 2) other ISV against a therapeutic target. These may further comprise a half-life extending ISV (such as an ISV against serum albumin).

In the polypeptides/constructs described in this table, at least one of the ISV's against c-Met present is an ISV of the invention, and preferably all of the ISV's against c-Met present in such polypeptide/construct are ISV's of the invention. Also, when a half-life extending ISV and/or an ISV against another therapeutic target is present in such polypeptide/construct, each of these (and preferably all of these) may also be (and preferably are) ISV's of the invention ([2])All "bivalent" constructs in this Table may also be biparatopic, meaning that they comprise at least two (such as two) ISV's against c-Met, which are directed against different epitopes on c-Met.

([3]) As will be clear to the skilled person, other/further bispecific constructs than those listed can be made using the building blocks and linkers mentioned.

([4]) Preferably, each [c-Met] present is independently chosen from SEQ ID NO's: 464 to 477 and/or 482 to 495. Also, the [c-Met] present may be the same or different; in a biparatopic polypeptide/construct they will be directed against different epitopes on c-Met.

([5]) Each of the polypeptides/constructs mentioned to in this column by means of reference to a SEQ ID forms an individual specific aspect of the invention.

Example 16: VH Domains (and in Particular Nanobodies) Against RANK-L, and Compounds of the Invention Comprising the Same In one specific aspect, the VH domains of the invention (and in particular ISVDs of the invention and more in particular Nanobodies of the invention) and compounds of the invention may be directed against RANK-L.

Such a VH domain of the invention against RANK-L will generally comprise: (i) suitable framework sequences that suitably comprise the amino acid residues/mutations of the invention as described herein; as well as (ii) CDR sequences that allow the VH domain of the invention to specifically bind to RANK-L. In addition, such a VH domain of the invention against RANK-L may also suitably have a C-terminal extension as described herein, in particular when said VH domain is monovalent or forms the C-terminal end of the compound of the invention in which said VH domain is present (again, as further described herein). Such VH domains of the invention against RANK-L may further be as further described herein, and may in particular be ISVD's.

Again, as with other aspects and embodiments of the invention described herein, when a specific ISVD (such as the ISVD against RANK-L described in this Example) or compound comprising the same is said to be "according to the invention" or "as further described herein", the preferred aspects/embodiments and preferences that are generally described herein for the ISVD's or compounds of the invention also specifically apply to said specific ISVD or compound, respectively, unless explicitly indicated otherwise or unless the specific technical context requires otherwise.

Thus, in a particular aspect, the present invention relates to a VH domain (and in particular an ISVD) that is directed against RANK-L, in which (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). In particular, in such VH domains against RANK-L:

- the amino acid residue at position 11 is preferably chosen from L, V or K (and is most preferably V); and
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v).

The VH domains of the invention against RANK-L may further be as described herein and may again in particular be an ISVD (and more in particular a Nanobody) against RANK-L or a protein, polypeptide or other compound or construct that comprises as least one such ISVD. Such a protein, polypeptide or other compound or construct may also be as further described herein, and may for example have an increased half-life (i.e. as described herein, e.g. a half-life—expressed as t1/2 beta—in human subjects of in human subjects of at least 1 day, preferably at least 3 days, more preferably at least 7 days, such as at least 10 days), and for this purpose may for example comprise a serum-albumin binding Nanobody, which may also be a serum-albumin binding Nanobody of the invention (again, as described herein).

Also, such an ISVD may suitably have a C-terminal extension (as further described herein and in WO 12/175741), in particular when said ISVD forms the C-terminal end of a protein, polypeptide or other compound or construct comprising the same (again, as further described herein).

In one preferred aspect, the VH domains of the invention against RANK-L comprise (i) a CDR1 sequence that is the sequence of SEQ ID NO: 389 (which is preferred) or that is an amino acid sequence that has only one amino acid difference with the sequence of SEQ ID NO: 389; (ii) a CDR2 sequence that is the sequence of SEQ ID NO: 390 (which is preferred) or that is an amino acid sequence that has only one or two amino acid differences with the sequence of SEQ ID NO: 390; and (iii) a CDR3 sequence that is the sequence of SEQ ID NO: 391 (which is preferred) or that is an amino acid sequence that has only one or two amino acid differences with the sequence of SEQ ID NO: 391.

More preferably, in a VH domain of the invention against RANK-L according to this aspect: (i) CDR1 is SEQ ID NO: 389; (ii) CDR2 is SEQ ID NO: 390; and (iii) CDR3 is SEQ ID NO: 391.

In one specific aspect, a Nanobody of the invention against RANK-L is a variant of the Nanobody of SEQ ID NO: 388 (with at least 90% sequence identity, such as at least 95% sequence identity, with SEQ ID NO: 388), in which:

the amino acid residue at position 11 is preferably chosen from L, V or K (and is most the amino acid residue at position 14 is preferably suitably chosen from A or P; and the amino acid residue at position 41 is preferably suitably chosen from A or P; and the amino acid residue at position 89 is preferably suitably chosen from T, V or L; and the amino acid residue at position 108 is preferably suitably chosen from Q or L; and the amino acid residue at position 110 is preferably suitably chosen from T, K or Q; and the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). The CDR's of such an ISV are preferably as defined in the preceding two paragraphs.

Some specifically preferred, but non-limiting examples of Nanobodies of the invention against RANK-L are listed in FIG. 19 as SEQ ID NO's: 392 to 405; and each of these Nanobodies form a further aspect of the invention.

The invention also relates to a compound of the invention against RANK-L that comprises at least one (such as one, two or three) of the Nanobodies of the invention of SEQ ID NO's: 392 to 405. Such compounds of the invention against RANK-L may again be as further described herein, and thus for example may comprise suitable linkers, may comprise a C-terminal extension as described herein, and may be half-life extended (for example because they comprise a Nanobody against human serum albumin, such as (preferably) a Nanobody of the invention against human serum albumin). Reference is made to Table Z below.

Some specifically preferred examples of compounds of the invention against RANK-L are given in FIG. 29 as SEQ ID NO's: 694 to 729; and each of these compounds form a further aspect of the invention. Thus, in another aspect, the invention relates to a polypeptide that is directed against RANK-L and that has an amino acid sequence that is chosen from the group consisting of SEQ ID NO's: 694 to 729.

More generally, compounds of the invention against RANK-L may be as described in WO 2008/142164, but comprising ISV's of the invention. They may also be used for the purposes described in WO 2008/142164.

TABLE Z

Examples of compounds of the invention against RANK-L.

| Polypeptide/ construct(1) | General formula | ISV building blocks and linkers |
|---|---|---|
| Monovalent | [RANK-L] | [RANK-L] = one of SEQ ID NO's: 464 to 477 and/or 482 to 495 |
| Monovalent/ C-terminal extension | [RANK-L]-X(n) | [RANK-L] = one of SEQ ID NO's: 464 to 477 and/or 482 to 495 |
| Monovalent/ half-life extended | [RANK-L]-$L_1$-[SA]<br>[SA]-$L_1$-[RANK-L] | [RANK-L] = one of SEQ ID NO's: 464 to 477 and/or 482 to 495<br>[SA] = (see legend below)<br>$L_1$ = (see legend below) |
| Monovalent/ half-life extended/C-terminal extension | [RANK-L]-$L_1$-[SA]-X(n)<br>[SA]-$L_1$-[RANK-L]-X(n) | [RANK-L] = one of SEQ ID NO's: 464 to 477 and/or 482 to 495<br>[SA] = (see legend below)<br>$L_1$ = (see legend below)<br>X(n) = (see legend below) |
| Bivalent(2) | [RANK-L]-$L_1$-[RANK-L] | At least one [RANK-L] present is = one of SEQ ID NO's: 464 to 477 and/or 482 to 495 (4)<br>$L_1$ = (see legend below) |
| Bivalent/ C-terminal extension(2) | [RANK-L]-$L_1$-[RANK-L]-X(n) | At least one [RANK-L] = one of SEQ ID NO's: 464 to 477 and/or 482 to 495 (4)<br>$L_1$ = (see legend below)<br>X(n) = (see legend below) |

TABLE Z-continued

Examples of compounds of the invention against RANK-L.

| Polypeptide/ construct(1) | General formula | ISV building blocks and linkers |
|---|---|---|
| Bivalent/ half-life extended(2) | [RANK-L]-$L_1$-[RANK-L]-$L_2$-[SA]<br>[RANK-L]-$L_1$-[SA]-$L_2$-[RANK-L]<br>[SA]-$L_1$-[RANK-L]-$L_2$-[RANK-L] | At least one [RANK-L] present is = one of SEQ ID NO's: 464 to 477 and/or 482 to 495 (4)<br>[SA] = (see legend below)<br>$L_1$ = (see legend below)<br>$L_2$ = (see legend below) |
| Bivalent/ half-life extended/ C-terminal extension(2) | [RANK-L]-$L_1$-[RANK-L]-$L_2$-[SA]-X(n)<br>[RANK-L]-$L_1$-[SA]-$L_2$-[RANK-L]-X(n)<br>[SA]-$L_1$-[RANK-L]-$L_2$-[RANK-L]-X(n) | At least one [RANK-L] present is = one of SEQ ID NO's: 464 to 477 and/or 482 to 495 (4)<br>[SA] = (see legend below)<br>$L_1$ = (see legend below)<br>$L_2$ = (see legend below)<br>X(n) = (see legend below) |
| Bispecific (3) | [RANK-L]-$L_1$-[Nb]<br>[Nb]-$L_1$-[RANK-L]<br>[RANK-L]-$L_1$-[RANK-L]-$L_2$-[Nb]<br>[RANK-L]-$L_1$-[Nb]-$L_2$-[RANK-L]<br>[Nb]-$L_1$-[RANK-L]-$L_2$-[RANK-L] | At least one [RANK-L] present is = one of SEQ ID NO's: 464 to 477 and/or 482 to 495 (4)<br>$L_1$ = (see legend below)<br>$L_2$ = (see legend below)<br>[Nb] = (see legend below) |
| Bispecific/ C-terminal extension (3) | [RANK-L]-$L_1$-[Nb]-X(n)<br>[Nb]-$L_1$-[RANK-L]-X(n)<br>[RANK-L]-$L_1$-[RANK-L]-$L_2$-[Nb]-X(n)<br>[RANK-L]-$L_1$-[Nb]-$L_2$-[RANK-L]-X(n)<br>[Nb]-$L_1$-[RANK-L]-$L_2$-[RANK-L]-X(n) | At least one [RANK-L] present is = one of SEQ ID NO's: 464 to 477 and/or 482 to 495 (4)<br>$L_1$ = (see legend below)<br>$L_2$ = (see legend below)<br>X(n) = (see legend below)<br>[Nb] = (see legend below) |
| Bispecific/ half-life extended (3) | [RANK-L]-$L_1$-[Nb]-$L_2$-[SA]<br>[RANK-L]-$L_1$-[SA]-$L_2$-[Nb]<br>[Nb]-$L_1$-[SA]-$L_2$-[RANK-L]<br>[Nb]-$L_1$-[RANK-L]-$L_2$-[SA]<br>[SA]-$L_1$-[RANK-L]-$L_2$-[Nb]<br>[SA]-$L_1$-[Nb]-$L_2$-[RANK-L] | At least one [RANK-L] present is = one of SEQ ID NO's: 464 to 477 and/or 482 to 495 (4)<br>[SA] = (see legend below)<br>$L_1$, $L_2$, $L_3$(see legend below)<br>[Nb] = (see legend below) |
| Bispecific/ half-life extended (3) | [RANK-L]-$L_1$-[RANK-L]-$L_2$-[Nb]-$L_3$-[SA]<br>[Nb]-$L_1$-[RANK-L]-$L_2$-[RANK-L]-$L_3$-[SA]<br>[SA]-$L_1$-[RANK-L]-$L_2$-[RANK-L]-$L_3$-[Nb]<br>[SA]-$L_1$-[RANK-L]-$L_2$-[Nb]-$L_3$-[RANK-L]<br>[RANK-L]-$L_1$-[Nb]-$L_2$-[RANK-L]-$L_3$-[SA] | At least one [RANK-L] present is = one of SEQ ID NO's: 464 to 477 and/or 482 to 495 (4)<br>[SA] = (see legend below)<br>$L_1$, $L_2$, $L_3$(see legend below)<br>[Nb] = (see legend below) |
| Bispecific/ half-life extended/ C-terminal extension (3) | [RANK-L]-$L_1$-[Nb]-$L_2$-[SA]-X(n)<br>[RANK-L]-$L_1$-[SA]-$L_2$-[Nb]-X(n)<br>[Nb]-$L_1$-[SA]-$L_2$-[RANK-L]-X(n)<br>[Nb]-$L_1$-[RANK-L]-$L_2$-[SA]-X(n)<br>[SA]-$L_1$-[RANK-L]-$L_2$-[Nb]-X(n)<br>[SA]-$L_1$-[Nb]-$L_2$-[RANK-L]-X(n)<br>[RANK-L]-$L_1$-[RANK-L]-$L_2$-[Nb]-$L_3$-[SA]-X(n)<br>[Nb]-$L_1$-[RANK-L]-$L_2$-[RANK-L]-$L_3$-[SA]-X(n)<br>[SA]-$L_1$-[RANK-L]-$L_2$-[RANK-L]-$L_3$-[Nb]-X(n)<br>[SA]-$L_1$-[RANK-L]-$L_2$-[Nb]-$L_3$-[RANK-L]-X(n)<br>[RANK-L]-$L_1$-[Nb]-$L_2$-[RANK-L]-$L_3$-[SA]-X(n) | At least one [RANK-L] present is = one of SEQ ID NO's: 464 to 477 and/or 482 to 495 (4)<br>[SA] = (see legend below)<br>$L_1$, $L_2$, $L_3$(see legend below)<br>X(n) = (see legend below)<br>[Nb] = (see legend below) |

Legend:

[SA] is an ISV against (human) serum albumin, preferably an ISV of the invention against (human) serum albumin, more preferably one of SEQ ID NO's: 46 or 61 or even more preferably one of the ISVD's of the invention of SEQ ID NO's: 47, 54, 62, 69, 78, 86, 109, 116, 123, 130 or 496 to 513.
Each of $L_1$, $L_2$ and $L_3$ is (independently) a suitable linker. Each of $L_1$, $L_2$ and $L_3$ may (independently) be present or not. Non-limiting examples of suitable linkers are the gly-ser linkers referred to herein, such as the 9GS, 30GS or 35GS linker.
X(n) = a C-terminal extension as a C-terminal extension as described in herein and/or in WO 12/175741

[Nb] is an ISV against another therapeutic target.

Notes:

(1)In this Table:

"Monovalent" generally refers to polypeptides/constructs comprising a single ISV against RANK-L. These may further comprise a half-life extending ISV (such as an ISV against serum albumin).
"Bivalent" generally refers to polypeptides/constructs comprising two ISV's against RANK-L (which may be the same or different). These may again further comprise a half-life extending ISV (such as an ISV against serum albumin).
"Bispecific" generally refers to polypeptides/constructs comprising at least one (such as 1 or 2) ISV's against RANK-L and at least one (such as 1 or 2) other ISV against a therapeutic target. These may further comprise a half-life extending ISV (such as an ISV against serum albumin).
In the polypeptides/constructs described in this table, at least one of the ISV's against RANK-L present is an ISV of the invention, and preferably all of the ISV's against RANK-L present in such polypeptide/construct are ISV's of the invention. Also, when a half-life extending ISV and/or an ISV against another therapeutic target is present in such polypeptide/construct, each of these (and preferably all of these) may also be (and preferably are) ISV's of the invention
(2)All "bivalent" constructs in this Table may also be biparatopic, meaning that they comprise at least two (such as two) ISV's against RANK-L, which are directed against different epitopes on RANK-L.
(3) As will be clear to the skilled person, other/further bispecific constructs than those listed can be made using the building blocks and linkers mentioned.
(4) Preferably, each [RANK-L] present is independently chosen from SEQ ID NO's: 464 to 477 and/or 482 to 495. Also, the [RANK-L] present may be the same or different; in a biparatopic polypeptide/construct they will be directed against different epitopes on RANK-L.
(5) Each of the polypeptides/constructs mentioned to in this column by means of reference to a SEQ ID forms an individual specific aspect of the invention.

Example 17: VH Domains (and in Particular Nanobodies) Against CXCR-7, and Compounds of the Invention Comprising the Same In one specific aspect, the VH domains of the invention (and in particular ISVDs of the invention and more in particular Nanobodies of the invention) and compounds of the invention may be directed against CXCR-7.

Such a VH domain of the invention against CXCR-7 will generally comprise: (i) suitable framework sequences that suitably comprise the amino acid residues/mutations of the invention as described herein; as well as (ii) CDR sequences that allow the VH domain of the invention to specifically bind to CXCR-7. In addition, such a VH domain of the invention against CXCR-7 may also suitably have a C-terminal extension as described herein, in particular when said VH domain is monovalent or forms the C-terminal end of the compound of the invention in which said VH domain is present (again, as further described herein). Such VH domains of the invention against CXCR-7 may further be as further described herein, and may in particular be ISVD's.

Again, as with other aspects and embodiments of the invention described herein, when a specific ISVD (such as the ISVD against CXCR-7 described in this Example) or compound comprising the same is said to be "according to the invention" or "as further described herein", the preferred aspects/embodiments and preferences that are generally described herein for the ISVD's or compounds of the invention also specifically apply to said specific ISVD or compound, respectively, unless explicitly indicated otherwise or unless the specific technical context requires otherwise.

Thus, in a particular aspect, the present invention relates to a VH domain (and in particular an ISVD) that is directed against CXCR-7, in which (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). In particular, in such VH domains against CXCR-7:

- the amino acid residue at position 11 is preferably chosen from L, V or K (and is most preferably V); and
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v).

The VH domains of the invention against CXCR-7 may further be as described herein and may again in particular be an ISVD (and more in particular a Nanobody) against CXCR-7 or a protein, polypeptide or other compound or construct that comprises as least one such ISVD. Such a protein, polypeptide or other compound or construct may also be as further described herein, and may for example have an increased half-life (i.e. as described herein, e.g. a half-life—expressed as t1/2 beta—in human subjects of in human subjects of at least 1 day, preferably at least 3 days, more preferably at least 7 days, such as at least 10 days), and for this purpose may for example comprise a serum-albumin binding Nanobody, which may also be a serum-albumin binding Nanobody of the invention (again, as described herein).

Also, such an ISVD may suitably have a C-terminal extension (as further described herein and in WO 12/175741), in particular when said ISVD forms the C-terminal end of a protein, polypeptide or other compound or construct comprising the same (again, as further described herein).

In one preferred aspect, the VH domains of the invention against CXCR-7 comprise (i) a CDR1 sequence that is the sequence of SEQ ID NO: 407 (which is preferred) or that is an amino acid sequence that has only one amino acid difference with the sequence of SEQ ID NO: 407; (ii) a CDR2 sequence that is the sequence of SEQ ID NO: 408 (which is preferred) or that is an amino acid sequence that has only one or two amino acid differences with the sequence of SEQ ID NO: 408; and (iii) a CDR3 sequence that is the sequence of SEQ ID NO: 409 (which is preferred) or that is an amino acid sequence that has only one or two amino acid differences with the sequence of SEQ ID NO: 409.

More preferably, in a VH domain of the invention against CXCR-7 according to this aspect: (i) CDR1 is SEQ ID NO: 407; (ii) CDR2 is SEQ ID NO: 408; and (iii) CDR3 is SEQ ID NO: 409.

In one specific aspect, a Nanobody of the invention against CXCR-7 is a variant of the Nanobody of SEQ ID NO: 406 (with at least 90% sequence identity, such as at least 95% sequence identity, with SEQ ID NO: 406), in which:

- the amino acid residue at position 11 is preferably chosen from L, V or K (and is most
- the amino acid residue at position 14 is preferably suitably chosen from A or P; and
- the amino acid residue at position 41 is preferably suitably chosen from A or P; and
- the amino acid residue at position 89 is preferably suitably chosen from T, V or L; and
- the amino acid residue at position 108 is preferably suitably chosen from Q or L; and
- the amino acid residue at position 110 is preferably suitably chosen from T, K or Q; and
- the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). The CDR's of such an ISV are preferably as defined in the preceding two paragraphs.

In another preferred aspect, the VH domains of the invention against CXCR-7 comprise (i) a CDR1 sequence that is the sequence of SEQ ID NO: 425 (which is preferred) or that is an amino acid sequence that has only one amino acid difference with the sequence of SEQ ID NO: 425; (ii) a CDR2 sequence that is the sequence of SEQ ID NO: 426 (which is preferred) or that is an amino acid sequence that has only one or two amino acid differences with the sequence of SEQ ID NO: 426; and (iii) a CDR3 sequence that is the sequence of SEQ ID NO: 427 (which is preferred) or that is an amino acid sequence that has only one or two amino acid differences with the sequence of SEQ ID NO: 427.

More preferably, in a VH domain of the invention against CXCR-7 according to this aspect: (i) CDR1 is SEQ ID NO: 425; (ii) CDR2 is SEQ ID NO: 426; and (iii) CDR3 is SEQ ID NO: 427.

In one specific aspect, a Nanobody of the invention against CXCR-7 is a variant of the Nanobody of SEQ ID NO: 424 (with at least 90% sequence identity, such as at least 95% sequence identity, with SEQ ID NO: 424), in which:

- the amino acid residue at position 11 is preferably chosen from L, V or K (and is most preferably V); and the amino acid residue at position 14 is preferably suitably chosen from A or P; and the amino acid residue at position 41 is preferably suitably chosen from A or P; and the amino acid residue at position 89 is preferably suitably chosen from T, V or L; and the amino acid residue at position 108 is preferably suitably chosen from Q or L; and the amino acid residue at position 110 is preferably suitably chosen from T, K or Q; and the amino acid residue at position 112 is preferably suitably chosen from S, K or Q:

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). Again, the CDR's of such an ISV are preferably as defined in the preceding two paragraphs.

Some specifically preferred, but non-limiting examples of Nanobodies of the invention against CXCR-7 are listed in FIG. 20A as SEQ ID NO's: 410 to 423 and in FIG. 20B as SEQ ID NO's: 428 to 441; and each of these Nanobodies form a further aspect of the invention.

The invention also relates to a compound of the invention against CXCR-7 that comprises at least one (such as one, two or three) of the Nanobodies of the invention of SEQ ID NO's: 410 to 423 and/or 428 to 441. Such compounds of the invention against CXCR-7 may again be as further described herein, and thus for example may comprise suitable linkers, may comprise a C-terminal extension as described herein, and may be half-life extended (for example because they comprise a Nanobody against human serum albumin, such as (preferably) a Nanobody of the invention against human serum albumin). Reference is made to Table AA below.

As described in for example WO2012/130874, one particularly preferred class of Nanobody-based compounds against CXCR7 are biparatopic compounds. Thus, in one aspect of the invention, a compound of the invention against CXCR-7 is a biparatopic construct that comprises one ISV that is either SEQ ID NO: 406 or (preferably) an ISV of the invention that has been derived from SEQ ID NO: 406 (as described in this Example 17) and one ISV that is either SEQ ID NO: 424 or (preferably) an ISV of the invention that has been derived from SEQ ID NO: 424 (as described in this Example 17), provided that at least one (and preferably both) of these ISV's are ISV's of the invention. Such biparatopic constructs may also be half-life extended (i.e. by means of a serum albumin-binding ISV).

More generally, compounds of the invention against CXCR-7 may be as described in WO2012/130874, but comprising ISV's of the invention. They may also be used for the purposes described in WO2012/130874.

TABLE AA

Examples of compounds of the invention against CXCR-7.

| Polypeptide/ construct([1]) | General formula | ISV building blocks and linkers |
|---|---|---|
| Monovalent | [CXCR-7] | [CXCR-7] = one of SEQ ID NO's: 464 to 477 and/or 482 to 495 |
| Monovalent/ C-terminal extension | [CXCR-7]-X(n) | [CXCR-7] = one of SEQ ID NO's: 464 to 477 and/or 482 to 495 |
| Monovalent/ half-life extended | [CXCR-7]-$L_1$-[SA]<br>[SA]-$L_1$-[CXCR-7] | [CXCR-7] = one of SEQ ID NO's: 464 to 477 and/or 482 to 495<br>[SA] = (see legend below)<br>$L_1$ = (see legend below) |
| Monovalent/ half-life extended/C-terminal extension | [CXCR-7]-$L_1$-[SA]-X(n)<br>[SA]-$L_1$-[CXCR-7]-X(n) | [CXCR-7] = one of SEQ ID NO's: 464 to 477 and/or 482 to 495<br>[SA] = (see legend below)<br>$L_1$ = (see legend below)<br>X(n) = (see legend below) |
| Bivalent([2]) | [CXCR-7]-$L_1$-[CXCR-7] | At least one [CXCR-7] present is = one of SEQ ID NO's: 464 to 477 and/or 482 to 495 ([4])<br>$L_1$ = (see legend below) |
| Bivalent/ C-terminal extension([2]) | [CXCR-7]-$L_1$-[CXCR-7]-X(n) | At least one [CXCR-7] = one of SEQ ID NO's: 464 to 477 and/or 482 to 495 ([4])<br>$L_1$ = (see legend below)<br>X(n) = (see legend below) |
| Bivalent/ half-life extended([2]) | [CXCR-7]-$L_1$-[CXCR-7]-$L_2$-[SA]<br>[CXCR-7]-$L_1$-[SA]-$L_2$-[CXCR-7]<br>[SA]-$L_1$-[CXCR-7]-$L_2$-[CXCR-7] | At least one [CXCR-7] present is = one of SEQ ID NO's: 464 to 477 and/or 482 to 495 ([4])<br>[SA] = (see legend below)<br>$L_1$ = (see legend below)<br>$L_2$ = (see legend below) |
| Bivalent/ half-life extended/ C-terminal extension([2]) | [CXCR-7]-$L_1$-[CXCR-7]-$L_2$-[SA]-X(n)<br>[CXCR-7]-$L_1$-[SA]-$L_2$-[CXCR-7]-X(n)<br>[SA]-$L_1$-[CXCR-7]-$L_2$-[CXCR-7]-X(n) | At least one [CXCR-7] present is = one of SEQ ID NO's: 464 to 477 and/or 482 to 495 ([4])<br>[SA] = (see legend below)<br>$L_1$ = (see legend below)<br>$L_2$ = (see legend below)<br>X(n) = (see legend below) |
| Bispecific ([3]) | [CXCR-7]-$L_1$-[Nb]<br>[Nb]-$L_1$-[CXCR-7]<br>[CXCR-7]-$L_1$-[CXCR-7]-$L_2$-[Nb]<br>[CXCR-7]-$L_1$-[Nb]-$L_2$-[CXCR-7]<br>[Nb]-$L_1$-[CXCR-7]-$L_2$-[CXCR-7] | At least one [CXCR-7] present is = one of SEQ ID NO's: 464 to 477 and/or 482 to 495 ([4])<br>$L_1$ = (see legend below)<br>$L_2$ = (see legend below)<br>[Nb] = (see legend below) |

TABLE AA-continued

Examples of compounds of the invention against CXCR-7.

| Polypeptide/ construct([1]) | General formula | ISV building blocks and linkers |
|---|---|---|
| Bispecific/ C-terminal extension ([3]) | [CXCR-7]-$L_1$-[Nb]-X(n)<br>[Nb]-$L_1$-[CXCR-7]-X(n)<br>[CXCR-7]-$L_1$-[CXCR-7]-$L_2$-[Nb]-X(n)<br>[CXCR-7]-$L_1$-[Nb]-$L_2$-[CXCR-7]-X(n)<br>[Nb]-$L_1$-[CXCR-7]-$L_2$-[CXCR-7]-X(n) | At least one [CXCR-7] present is = one of SEQ ID NO's: 464 to 477 and/or 482 to 495 ([4])<br>$L_1$ = (see legend below)<br>$L_2$ = (see legend below)<br>X(n) = (see legend below)<br>[Nb] = (see legend below) |
| Bispecific/ half-life extended ([3]) | [CXCR-7]-$L_1$-[Nb]-$L_2$-[SA]<br>[CXCR-7]-$L_1$-[SA]-$L_2$-[Nb]<br>[Nb]-$L_1$-[SA]-$L_2$-[CXCR-7]<br>[Nb]-$L_1$-[CXCR-7]-$L_2$-[SA]<br>[SA]-$L_1$-[CXCR-7]-$L_2$-[Nb]<br>[SA]-$L_1$-[Nb]-$L_2$-[CXCR-7] | At least one [CXCR-7] present is = one of SEQ ID NO's: 464 to 477 and/or 482 to 495 ([4])<br>[SA] = (see legend below)<br>$L_1$, $L_2$, $L_3$(see legend below)<br>[Nb] = (see legend below) |
| Bispecific/ half-life extended ([3]) | [CXCR-7]-$L_1$-[CXCR-7]-$L_2$-[Nb]-$L_3$-[SA]<br>[Nb]-$L_1$-[CXCR-7]-$L_2$-[CXCR-7]-$L_3$-[SA]<br>[SA]-$L_1$-[CXCR-7]-$L_2$-[CXCR-7]-$L_3$-[Nb]<br>[SA]-$L_1$-[CXCR-7]-$L_2$-[Nb]-$L_3$-[CXCR-7]<br>[CXCR-7]-$L_1$-[Nb]-$L_2$-[CXCR-7]-$L_3$-[SA] | At least one [CXCR-7] present is = one of SEQ ID NO's: 464 to 477 and/or 482 to 495 ([4])<br>[SA] = (see legend below)<br>$L_1$, $L_2$, $L_3$(see legend below)<br>[Nb] = (see legend below) |
| Bispecific/ half-life extended/ C-terminal extension ([3]) | [CXCR-7]-$L_1$-[Nb]-$L_2$-[SA]-X(n)<br>[CXCR-7]-$L_1$-[SA]-$L_2$-[Nb]-X(n)<br>[Nb]-$L_1$-[SA]-$L_2$-[CXCR-7]-X(n)<br>[Nb]-$L_1$-[CXCR-7]-$L_2$-[SA]-X(n)<br>[SA]-$L_1$-[CXCR-7]-$L_2$-[Nb]-X(n)<br>[SA]-$L_1$-[Nb]-$L_2$-[CXCR-7]-X(n)<br>[CXCR-7]-$L_1$-[CXCR-7]-$L_2$-[Nb]-$L_3$-[SA]-X(n)<br>[Nb]-$L_1$-[CXCR-7]-$L_2$-[CXCR-7]-$L_3$-[SA]-X(n)<br>[SA]-$L_1$-[CXCR-7]-$L_2$-[CXCR-7]-$L_3$-[Nb]-X(n)<br>[SA]-$L_1$-[CXCR-7]-$L_2$-[Nb]-$L_3$-[CXCR-7]-X(n)<br>[CXCR-7]-$L_1$-[Nb]-$L_2$-[CXCR-7]-$L_3$-[SA]-X(n) | At least one [CXCR-7] present is = one of SEQ ID NO's: 464 to 477 and/or 482 to 495 ([4])<br>[SA] = (see legend below)<br>$L_1$, $L_2$, $L_3$(see legend below)<br>X(n) = (see legend below)<br>[Nb] = (see legend below) |

Legend:

[SA] is an ISV against (human) serum albumin, preferably an ISV of the invention against (human) serum albumin, more preferably one of SEQ ID NO's: 46 or 61 or even more preferably one of the ISVD's of the invention of SEQ ID NO's: 47, 54, 62, 69, 78, 86, 109, 116, 123, 130 or 496 to 513.

Each of $L_1$, $L_2$ and $L_3$ is (independently) a suitable linker. Each of $L_1$, $L_2$ and $L_3$ may (independently) be present or not. Non-limiting examples of suitable linkers are the gly-ser linkers referred to herein, such as the 9GS, 30GS or 35GS linker.

X(n) = a C-terminal extension as a C-terminal extension as described in herein and/or in WO 12/175741

[Nb] is an ISV against another therapeutic target.

Notes:

([1])In this Table:

"Monovalent" generally refers to polypeptides/constructs comprising a single ISV against CXCR-7. These may further comprise a half-life extending ISV (such as an ISV against serum albumin).

"Bivalent" generally refers to polypeptides/constructs comprising two ISV's against CXCR-7 (which may be the same or different). These may again further comprise a half-life extending ISV (such as an ISV against serum albumin).

"Bispecific" generally refers to polypeptides/constructs comprising at least one (such as 1 or 2) ISV's against CXCR-7 and at least one (such as 1 or 2) other ISV against a therapeutic target. These may further comprise a half-life extending ISV (such as an ISV against serum albumin).

In the polypeptides/constructs described in this table, at least one of the ISV's against CXCR-7 present is an ISV of the invention, and preferably all of the ISV's against CXCR-7 present in such polypeptide/construct are ISV's of the invention. Also, when a half-life extending ISV and/or an ISV against another therapeutic target is present in such polypeptide/construct, each of these (and preferably all of these) may also be (and preferably are) ISV's of the invention ([2])All "bivalent" constructs in this Table may also be biparatopic, meaning that they comprise at least two (such as two) ISV's against CXCR-7, which are directed against different epitopes on CXCR-7.

([3]) As will be clear to the skilled person, other/further bispecific constructs than those listed can be made using the building blocks and linkers mentioned.

([4]) Preferably, each [CXCR-7] present is independently chosen from SEQ ID NO's: 464 to 477 and/or 482 to 495. Also, the [CXCR-7] present may be the same or different; in a biparatopic polypeptide/construct they will be directed against different epitopes on CXCR-7.

([5]) Each of the polypeptides/constructs mentioned to in this column by means of reference to a SEQ ID forms an individual specific aspect of the invention.

Example 18: VH Domains (and in Particular Nanobodies) Against A-Beta, and Compounds of the Invention Comprising the Same In one specific aspect, the VH domains of the invention (and in particular ISVDs of the invention and more in particular Nanobodies of the invention) and compounds of the invention may be directed against A-beta.

Such a VH domain of the invention against A-beta will generally comprise: (i) suitable framework sequences that suitably comprise the amino acid residues/mutations of the invention as described herein; as well as (ii) CDR sequences that allow the VH domain of the invention to specifically bind to A-beta. In addition, such a VH domain of the invention against A-beta may also suitably have a C-terminal extension as described herein, in particular when said VH domain is monovalent or forms the C-terminal end of the compound of the invention in which said VH domain is present (again, as further described herein). Such VH domains of the invention against A-beta may further be as further described herein, and may in particular be ISVD's.

Again, as with other aspects and embodiments of the invention described herein, when a specific ISVD (such as the ISVD against A-beta described in this Example) or compound comprising the same is said to be "according to the invention" or "as further described herein", the preferred aspects/embodiments and preferences that are generally described herein for the ISVD's or compounds of the invention also specifically apply to said specific ISVD or compound, respectively, unless explicitly indicated otherwise or unless the specific technical context requires otherwise.

Thus, in a particular aspect, the present invention relates to a VH domain (and in particular an ISVD) that is directed against A-beta, in which (i) position 112 is K or Q; or (ii) position 110 is K or Q and position 11 is V; or (iii) position 89 is T; or (iv) position 89 is L and position 110 is K or Q;

or (v) position 11 is V and position 89 is L; or any suitable combination of (i) to (v). In particular, in such VH domains against A-beta:

the amino acid residue at position 11 is preferably chosen from L, V or K (and is most preferably V); and the amino acid residue at position 14 is preferably suitably chosen from A or P; and the amino acid residue at position 41 is preferably suitably chosen from A or P; and the amino acid residue at position 89 is preferably suitably chosen from T, V or L; and the amino acid residue at position 108 is preferably suitably chosen from Q or L; and the amino acid residue at position 110 is preferably suitably chosen from T, K or Q; and the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v).

The VH domains of the invention against A-beta may further be as described herein and may again in particular be an ISVD (and more in particular a Nanobody) against A-beta or a protein, polypeptide or other compound or construct that comprises as least one such ISVD. Such a protein, polypeptide or other compound or construct may also be as further described herein, and may for example have an increased half-life (i.e. as described herein, e.g. a half-life—expressed as t1/2 beta—in human subjects of in human subjects of at least 1 day, preferably at least 3 days, more preferably at least 7 days, such as at least 10 days), and for this purpose may for example comprise a serum-albumin binding Nanobody, which may also be a serum-albumin binding Nanobody of the invention (again, as described herein).

Also, such an ISVD may suitably have a C-terminal extension (as further described herein and in WO 12/175741), in particular when said ISVD forms the C-terminal end of a protein, polypeptide or other compound or construct comprising the same (again, as further described herein).

In one preferred aspect, the VH domains of the invention against A-beta comprise (i) a CDR1 sequence that is the sequence of SEQ ID NO: 461 (which is preferred) or that is an amino acid sequence that has only one amino acid difference with the sequence of SEQ ID NO: 461; (ii) a CDR2 sequence that is the sequence of SEQ ID NO: 462 (which is preferred) or that is an amino acid sequence that has only one or two amino acid differences with the sequence of SEQ ID NO: 462; and (iii) a CDR3 sequence that is the sequence of SEQ ID NO: 463 (which is preferred) or that is an amino acid sequence that has only one or two amino acid differences with the sequence of SEQ ID NO: 463.

More preferably, in a VH domain of the invention against A-beta according to this aspect: (i) CDR1 is SEQ ID NO: 461; (ii) CDR2 is SEQ ID NO: 462; and (iii) CDR3 is SEQ ID NO: 463.

In one specific aspect, a Nanobody of the invention against A-beta is a variant of the Nanobody of SEQ ID NO: 460 (with at least 90% sequence identity, such as at least 95% sequence identity, with SEQ ID NO: 460), in which:

the amino acid residue at position 11 is preferably chosen from L, V or K (and is most the amino acid residue at position 14 is preferably suitably chosen from A or P; and the amino acid residue at position 41 is preferably suitably chosen from A or P; and the amino acid residue at position 89 is preferably suitably chosen from T, V or L; and the amino acid residue at position 108 is preferably suitably chosen from Q or L; and the amino acid residue at position 110 is preferably suitably chosen from T, K or Q; and the amino acid residue at position 112 is preferably suitably chosen from S, K or Q;

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). The CDR's of such an ISV are preferably as defined in the preceding two paragraphs.

In another preferred aspect, the VH domains of the invention against A-beta comprise (i) a CDR1 sequence that is the sequence of SEQ ID NO: 479 (which is preferred) or that is an amino acid sequence that has only one amino acid difference with the sequence of SEQ ID NO: 479; (ii) a CDR2 sequence that is the sequence of SEQ ID NO: 480 (which is preferred) or that is an amino acid sequence that has only one or two amino acid differences with the sequence of SEQ ID NO: 480; and (iii) a CDR3 sequence that is the sequence of SEQ ID NO: 481 (which is preferred) or that is an amino acid sequence that has only one or two amino acid differences with the sequence of SEQ ID NO: 481.

More preferably, in a VH domain of the invention against A-beta according to this aspect: (i) CDR1 is SEQ ID NO: 479; (ii) CDR2 is SEQ ID NO: 480; and (iii) CDR3 is SEQ ID NO: 481.

In one specific aspect, a Nanobody of the invention against A-beta is a variant of the Nanobody of SEQ ID NO: 478 (with at least 90% sequence identity, such as at least 95% sequence identity, with SEQ ID NO: 478), in which:

the amino acid residue at position 11 is preferably chosen from L, V or K (and is most preferably V); and the amino acid residue at position 14 is preferably suitably chosen from A or P; and the amino acid residue at position 41 is preferably suitably chosen from A or P; and the amino acid residue at position 89 is preferably suitably chosen from T, V or L; and the amino acid residue at position 108 is preferably suitably chosen from Q or L; and the amino acid residue at position 110 is preferably suitably chosen from T, K or Q; and the amino acid residue at position 112 is preferably suitably chosen from S, K or Q:

such that either (i) position 112 is K or Q; or (ii) position 110 is K or Q and position 11 is V; or (iii) position 89 is T; or (iv) position 89 is L and position 110 is K or Q; or (v) position 11 is V and position 89 is L; or any suitable combination of (i) to (v). Again, the CDR's of such an ISV are preferably as defined in the preceding two paragraphs.

Some specifically preferred, but non-limiting examples of Nanobodies of the invention against A-beta are listed in FIG. 21A as SEQ ID NO's: 464 to 477 and in FIG. 21B as SEQ ID NO's: 482 to 495; and each of these Nanobodies form a further aspect of the invention.

The invention also relates to a compound of the invention against A-beta that comprises at least one (such as one, two or three) of the Nanobodies of the invention of SEQ ID NO's: 464 to 477 and/or 482 to 495. Such compounds of the invention against A-beta may again be as further described herein, and thus for example may comprise suitable linkers, may comprise a C-terminal extension as described herein, and may be half-life extended (for example because they comprise a Nanobody against human serum albumin, such as (preferably) a Nanobody of the invention against human serum albumin). Reference is made to Table BB below.

As described in for example WO 2006/040153 and in particular as described in EP2542579, one particularly preferred class of Nanobody-based compounds against A-beta are biparatopic compounds. Thus, in one aspect of the invention, a compound of the invention against A-beta is a biparatopic construct that comprises one ISV that is either SEQ ID NO: 460 or (preferably) an ISV of the invention that has been derived from SEQ ID NO: 460 (as described in this Example 17) and one ISV that is either SEQ ID NO: 478 or (preferably) an ISV of the invention that has been derived from SEQ ID NO: 478 (as described in this Example 17), provided that at least one (and preferably both) of these ISV's are ISV's of the invention. Such biparatopic constructs may also be half-life extended (i.e. by means of a serum albumin-binding ISV). Some specific examples of such biparatopic constructs are given in SEQ ID NO: 730 to 766.

Some specifically preferred examples of compounds of the invention against A-beta are given in FIG. 30 as SEQ ID NO's: 730 to 766; and each of these compounds form a further aspect of the invention. Thus, in another aspect, the invention relates to a polypeptide that is directed against A-beta and that has an amino acid sequence that is chosen from the group consisting of SEQ ID NO's: 730 to 766. More generally, compounds of the invention against A-beta may be as described in WO 2006/040153 and in particular as described in EP2542579, but comprising ISV's of the invention. They may also be used for the purposes described in WO 2006/040153 and in particular EP2542579.

TABLE BB

Examples of compounds of the invention against A-beta.

| Polypeptide/ construct([1]) | General formula | ISV building blocks and linkers |
|---|---|---|
| Monovalent | [A-beta] | [A-beta] = one of SEQ ID NO's: 464 to 477 and/or 482 to 495 |
| Monovalent/ C-terminal extension | [A-beta]-X(n) | [A-beta] = one of SEQ ID NO's: 464 to 477 and/or 482 to 495 |
| Monovalent/ half-life extended | [A-beta]-$L_1$-[SA]<br>[SA]-$L_1$-[A-beta] | [A-beta] = one of SEQ ID NO's: 464 to 477 and/or 482 to 495<br>[SA] = (see legend below)<br>$L_1$ = (see legend below) |
| Monovalent/ half-life extended/C-terminal extension | [A-beta]-$L_1$-[SA]-X(n)<br>[SA]-$L_1$-[A-beta]-X(n) | [A-beta] = one of SEQ ID NO's: 464 to 477 and/or 482 to 495<br>[SA] = (see legend below)<br>$L_1$ = (see legend below)<br>X(n) = (see legend below) |
| Bivalent([2]) | [A-beta]-$L_1$-[A-beta] | At least one [A-beta] present is = one of SEQ ID NO's: 464 to 477 and/or 482 to 495 ([4])<br>$L_1$ = (see legend below) |
| Bivalent/ C-terminal extension([2]) | [A-beta]-$L_1$-[A-beta]-X(n) | At least one [A-beta] = one of SEQ ID NO's: 464 to 477 and/or 482 to 495 ([4])<br>$L_1$ = (see legend below)<br>X(n) = (see legend below) |
| Bivalent/ half-life extended([2]) | [A-beta]-$L_1$-[A-beta]-$L_2$-[SA]<br>[A-beta]-$L_1$-[SA]-$L_2$-[A-beta]<br>[SA]-$L_1$-[A-beta]-$L_2$-[A-beta] | At least one [A-beta] present is = one of SEQ ID NO's: 464 to 477 and/or 482 to 495 ([4])<br>[SA] = (see legend below)<br>$L_1$ = (see legend below)<br>$L_2$ = (see legend below) |
| Bivalent/ half-life extended/ C-terminal extension([2]) | [A-beta]-$L_1$-[A-beta]-$L_2$-[SA]-X(n)<br>[A-beta]-$L_1$-[SA]-$L_2$-[A-beta]-X(n)<br>[SA]-$L_1$-[A-beta]-$L_2$-[A-beta]-X(n) | At least one [A-beta] present is = one of SEQ ID NO's: 464 to 477 and/or 482 to 495 ([4])<br>[SA] = (see legend below)<br>$L_1$ = (see legend below)<br>$L_2$ = (see legend below)<br>X(n) = (see legend below) |
| Bispecific ([3]) | [A-beta]-$L_1$-[Nb]<br>[Nb]-$L_1$-[A-beta]<br>[A-beta]-$L_1$-[A-beta]-$L_2$-[Nb]<br>[A-beta]-$L_1$-[Nb]-$L_2$-[A-beta]<br>[Nb]-$L_1$-[A-beta]-$L_2$-[A-beta] | At least one [A-beta] present is = one of SEQ ID NO's: 464 to 477 and/or 482 to 495 ([4])<br>$L_1$ = (see legend below)<br>$L_2$ = (see legend below)<br>[Nb] = (see legend below) |
| Bispecific/ C-terminal extension ([3]) | [A-beta]-$L_1$-[Nb]-X(n)<br>[Nb]-$L_1$-[A-beta]-X(n)<br>[A-beta]-$L_1$-[A-beta]-$L_2$-[Nb]-X(n)<br>[A-beta]-$L_1$-[Nb]-$L_2$-[A-beta]-X(n)<br>[Nb]-$L_1$-[A-beta]-$L_2$-[A-beta]-X(n) | At least one [A-beta] present is = one of SEQ ID NO's: 464 to 477 and/or 482 to 495 ([4])<br>$L_1$ = (see legend below)<br>$L_2$ = (see legend below)<br>X(n) = (see legend below)<br>[Nb] = (see legend below) |
| Bispecific/ half-life extended ([3]) | [A-beta]-$L_1$-[Nb]-$L_2$-[SA]<br>[A-beta]-$L_1$-[SA]-$L_2$-[Nb]<br>[Nb]-$L_1$-[SA]-$L_2$-[A-beta]<br>[Nb]-$L_1$-[A-beta]-$L_2$-[SA]<br>[SA]-$L_1$-[A-beta]-$L_2$-[Nb]<br>[SA]-$L_1$-[Nb]-$L_2$-[A-beta] | At least one [A-beta] present is = one of SEQ ID NO's: 464 to 477 and/or 482 to 495 ([4])<br>[SA] = (see legend below)<br>$L_1$, $L_2$, $L_3$(see legend below)<br>[Nb] = (see legend below) |

TABLE BB-continued

Examples of compounds of the invention against A-beta.

| Polypeptide/ construct(1) | General formula | ISV building blocks and linkers |
|---|---|---|
| Bispecific/ half-life extended (3) | [A-beta]-$L_1$-[A-beta]-$L_2$-[Nb]-$L_3$-[SA]<br>[Nb]-$L_1$-[A-beta]-$L_2$-[A-beta]-$L_3$-[SA]<br>[SA]-$L_1$-[A-beta]-$L_2$-[A-beta]-$L_3$-[Nb]<br>[SA]-$L_1$-[A-beta]-$L_2$-[Nb]-$L_3$-[A-beta]<br>[A-beta]-$L_1$-[Nb]-$L_2$-[A-beta]-$L_3$-[SA] | At least one [A-beta] present is = one of SEQ ID NO's: 464 to 477 and/or 482 to 495 (4)<br>[SA] = (see legend below)<br>$L_1$, $L_2$, $L_3$(see legend below)<br>[Nb] = (see legend below) |
| Bispecific/ half-life extended/ C-terminal extension (3) | [A-beta]-$L_1$-[Nb]-$L_2$-[SA]-X(n)<br>[A-beta]-$L_1$-[SA]-$L_2$-[Nb]-X(n)<br>[Nb]-$L_1$-[SA]-$L_2$-[A-beta]-X(n)<br>[Nb]-$L_1$-[A-beta]-$L_2$-[SA]-X(n)<br>[SA]-$L_1$-[A-beta]-$L_2$-[Nb]-X(n)<br>[SA]-$L_1$-[Nb]-$L_2$-[12345]-X(n)<br>[A-beta]-$L_1$-[A-beta]-$L_2$-[Nb]-$L_3$-[SA]-X(n)<br>[Nb]-$L_1$-[A-beta]-$L_2$-[A-beta]-$L_3$-[SA]-X(n)<br>[SA]-$L_1$-[A-beta]-$L_2$-[A-beta]-$L_3$-[Nb]-X(n)<br>[SA]-$L_1$-[A-beta]-$L_2$-[Nb]-$L_3$-[A-beta]-X(n)<br>[A-beta]-$L_1$-[Nb]-$L_2$-[A-beta]-$L_3$-[SA]-X(n) | At least one [A-beta] present is = one of SEQ ID NO's: 464 to 477 and/or 482 to 495 (4)<br>[SA] = (see legend below)<br>$L_1$, $L_2$, $L_3$(see legend below)<br>X(n) = (see legend below)<br>[Nb] = (see legend below) |

Legend:

[SA] is an ISV against (human) serum albumin, preferably an ISV of the invention against (human) serum albumin, more preferably one of SEQ ID NO's: 46 or 61 or even more preferably one of the ISVD's of the invention of SEQ ID NO's: 47, 54, 62, 69, 78, 86, 109, 116, 123, 130 or 496 to 513.

Each of $L_1$, $L_2$ and $L_3$ is (independently) a suitable linker. Each of $L_1$, $L_2$ and $L_3$ may (independently) be present or not. Non-limiting examples of suitable linkers are the gly-ser linkers referred to herein, such as the 9GS, 30GS or 35GS linker.

X(n) = a C-terminal extension as a C-terminal extension as described in herein and/or in WO 12/175741

[Nb] is an ISV against another therapeutic target.

Notes:

(1)In this Table:

"Monovalent" generally refers to polypeptides/constructs comprising a single ISV against A-beta. These may further comprise a half-life extending ISV (such as an ISV against serum albumin).

"Bivalent" generally refers to polypeptides/constructs comprising two ISV's against A-beta (which may be the same or different). These may again further comprise a half-life extending ISV (such as an ISV against serum albumin).

"Bispecific" generally refers to polypeptides/constructs comprising at least one (such as 1 or 2) ISV's against A-beta and at least one (such as 1 or 2) other ISV against a therapeutic target. These may further comprise a half-life extending ISV (such as an ISV against serum albumin).

In the polypeptides/constructs described in this table, at least one of the ISV's against A-beta present is an ISV of the invention, and preferably all of the ISV's against A-beta present in such polypeptide/construct are ISV's of the invention. Also, when a half-life extending ISV and/or an ISV against another therapeutic target is present in such polypeptide/construct, each of these (and preferably all of these) may also be (and preferably are) ISV's of the invention (2)All "bivalent" constructs in this Table may also be biparatopic, meaning that they comprise at least two (such as two) ISV's against A-beta, which are directed against different epitopes on A-beta.

(3) As will be clear to the skilled person, other/further bispecific constructs than those listed can be made using the building blocks and linkers mentioned.

(4) Preferably, each [A-beta] present is independently chosen from SEQ ID NO's: 464 to 477 and/or 482 to 495. Also, the [A-beta] present may be the same or different; in a biparatopic polypeptide/construct they will be directed against different epitopes on A-beta.

(5) Each of the polypeptides/constructs mentioned to in this column by means of reference to a SEQ ID forms an individual specific aspect of the invention.

Figure 31A:
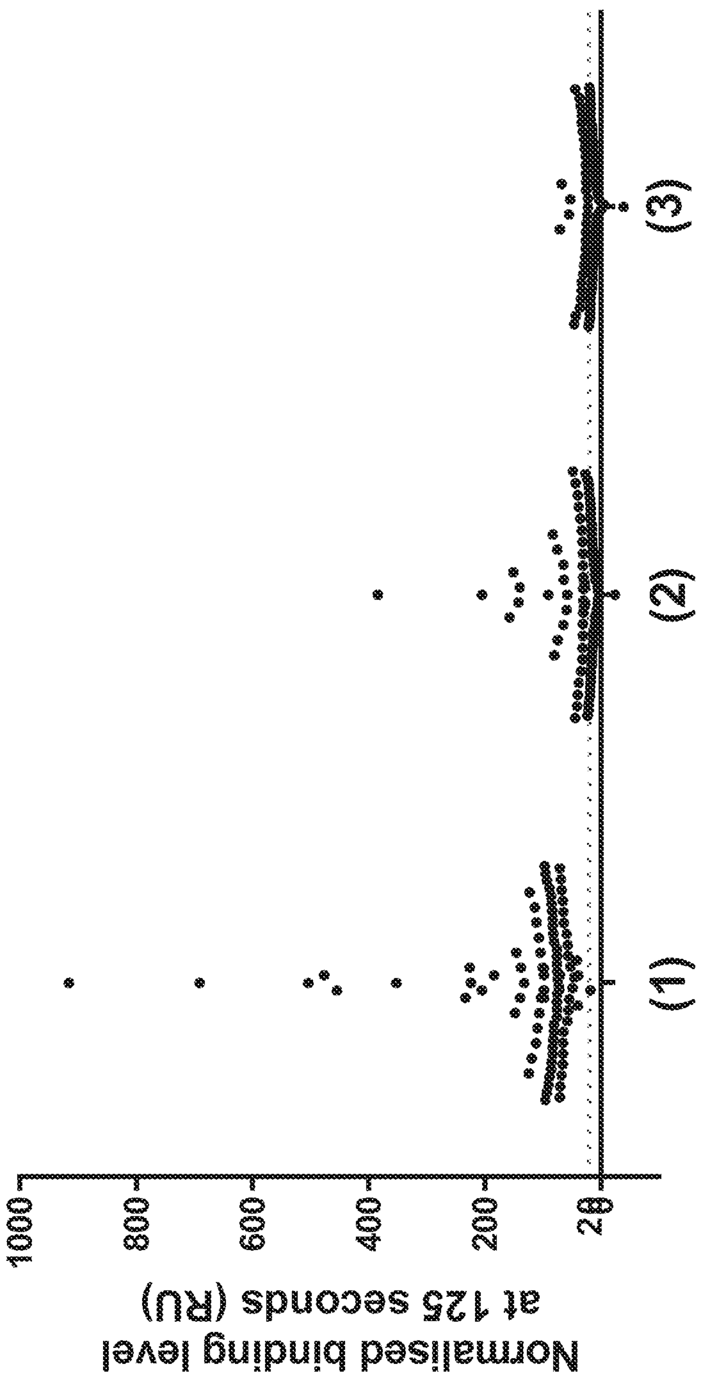
FIG. 31A is a plot showing data points obtained in Example 19 when 92 serum samples obtained from healthy volunteers were tested for binding representative trivalent bispecific half-life extended compounds of the invention against A-beta. Each dot represents a data point collected by testing of the indicated construct against one of the 92 serum samples. The reference numbers are as listed in Table CC-1. Similarly.
Figure 31B:
FIG. 31B is a plot showing data points obtained in Example 19 when 92 serum samples obtained from healthy volunteers were tested for binding the (monovalent) C-terminal Nanobodies that are present in the constructs tested in FIG. 31A. Each dot represents a data point collected by testing of the indicated construct against one of the 92 serum samples. The reference numbers are as listed in Table CC-2.

Example 19: Testing of Anti-A-Beta Constructs for Binding by Pre-Existing Antibodies Three half-life extended anti-A-beta constructs (with the general formula [A-beta-1]-9GS-ALB8-9GS-[A-beta-2]-A) were tested and compared for binding by pre-existing antibodies, using the general protocol described herein. The two constructs according to the invention had the indicated mutations of the invention in all three building blocks (i.e. in the two anti-A-beta Nanobodies and in the serum albumin-binding Nanobody). The reference construct (SEQ ID NO:766) had no mutations of the invention in any of the building blocks. All constructs tested has a C-terminal alanine. The results are given in Table CC-1 and FIG. 31A

TABLE CC-1 testing of anti-A-beta constructs for binding by pre-existing antibodies

| Nanobodies tested on 92 samples (healthy subjects) | Ref. no. in FIG. 30A | Binding Level at 125 seconds <10 RU | Binding Level at 125 seconds <20 RU | Binding Level at 125 seconds >20 RU |
|---|---|---|---|---|
| SEQ ID NO: 766 (reference) | (1) | 0 | 1 | 91 |
| SEQ ID NO: 733 (invention: L11V + V89L) | (2) | 11 | 41 | 51 |
| SEQ ID NO: 749 (invention: L11V + V89L + T110K) | (3) | 16 | 56 | 36 |

The anti-A-beta Nanobodies that were present at the C-terminal end of the constructs were also tested separately as monovalent constructs (with a C-terminal alanine). The results are given in Table CC-2 and FIG. 31A.

TABLE CC-2 testing of monovalent anti-A-beta Nanobodies for binding by pre-existing antibodies

| Nanobodies tested on 145 samples (healthy subjects) | Ref. no. in FIG. 30A | Binding Level at 125 seconds <10 RU | Binding Level at 125 seconds <20 RU | Binding Level at 125 seconds >20 RU |
|---|---|---|---|---|
| SEQ ID NO: 478 (reference) (*) | (1) | 67 | 87 | 58 |
| SEQ ID NO: 489 (invention: L11V + V89L) (*) | (2) | 74 | 103 | 42 |
| SEQ ID NO: 490 (invention: L11V + V89L + T110K) (*) | (3) | 116 | 138 | 7 |

(*) all three monovalent Nanobodies tested had a C-terminal alanine added

Example 20: Overview of Serum Albumin Binders of the Invention

Tables DD and EE below give some preferred, but non-limiting examples of serum albumin binding Nanobodies of the invention, based on Alb-8 (Table DD) and Alb-23 (Table EE), respectively.

As mentioned, the invention also relates to a polypeptide, protein, compound or construct (and in particular a compound of the invention) that comprises one of the serum albumin-binding Nanobodies listed in Table DD or EE below. Such a polypeptide, protein, compound or construct (and in particular a compound of the invention) may further comprise at least one (such as one, two or three) binding domain or binding unit (such as an ISVD, and in particular an ISV of the invention) that is directed against at least one therapeutic target. Such a polypeptide, protein, compound or construct may again suitably be monospecific, bispecific or trispecific with respect to the therapeutic target(s), and may be bivalent, trivalent, tetravalent or of higher valency. It will usually also contain suitable linkers, and may comprise a C-terminal extension as described herein.

In particular, such a polypeptide, protein, compound or construct may be a compound of the invention (as described herein) and/or may be as further described herein for the compounds of the invention (including preferred embodiments for compounds of the invention. Thus compounds comprising ISVD's and in particular Nanobodies are particularly preferred). Accordingly compounds of the invention comprising one of the serum albumin binding Nanobodies listed in Table DD or EE form further aspects of the invention.

TABLE DD

Alb-8 (reference) and Alb-8 variants according to the invention

| SEQ ID NO: | Variant | Sequence |
|---|---|---|
| 46 | Alb-8 (WO 06/122787) | EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS |

TABLE DD-continued

Alb-8 (reference) and Alb-8 variants according to the invention

| SEQ ID NO: | Variant | Sequence |
|---|---|---|
| 496 | 89L + 110K | EVQLVESGGGLVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSS |
| 497 | 89L + 110Q | EVQLVESGGGLVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSS |
| 498 | 110K | EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVKVSS |
| 499 | 110Q | EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVQVSS |
| 47 | 112K | EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVKS |
| 54 | 112Q | EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVQS |
| 78 | 89T | EVQLVESGGGLVQPGNSLRLSCAASGFTFSSFGMSWVRQAPGKGLEWVSSISGSGSDTLYADSVKGRFTISRDNAKTTLYLQMNSLRPEDTATYYCTIGGSLSRSSQGTLVTVSS |
| 109 | 11V + 89L | EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSS |
| 123 | 11V + 89L + 110K | EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSS |

TABLE DD-continued

Alb-8 (reference) and Alb-8 variants according to the invention

| SEQ ID NO: | Variant | Sequence |
|---|---|---|
| 500 | 11V + 89L + 110Q | EVQLVESGGGVVQPGNSLRLSCAASGFTFSSF GMSWVRQAPGKGLEWVSSISGSGSDTLYADSV KGRFTISRDNAKTTLYLQMNSLRPEDTALYYC TIGGSLSRSSQGTLVQVSS |
| 501 | 11V + 110K | EVQLVESGGGVVQPGNSLRLSCAASGFTFSSF GMSWVRQAPGKGLEWVSSISGSGSDTLYADSV KGRFTISRDNAKTTLYLQMNSLRPEDTAVYYC TIGGSLSRSSQGTLVKVSS |
| 502 | 11V + 110Q | EVQLVESGGGVVQPGNSLRLSCAASGFTFSSF GMSWVRQAPGKGLEWVSSISGSGSDTLYADSV KGRFTISRDNAKTTLYLQMNSLRPEDTAVYYC TIGGSLSRSSQGTLVQVSS |
| 503 | 11V + 112K | EVQLVESGGGVVQPGNSLRLSCAASGFTFSSF GMSWVRQAPGKGLEWVSSISGSGSDTLYADSV KGRFTISRDNAKTTLYLQMNSLRPEDTAVYYC TIGGSLSRSSQGTLVTVKS |
| 504 | 11V + 112Q | EVQLVESGGGVVQPGNSLRLSCAASGFTFSSF GMSWVRQAPGKGLEWVSSISGSGSDTLYADSV KGRFTISRDNAKTTLYLQMNSLRPEDTAVYYC TIGGSLSRSSQGTLVTVQS |

TABLE EE

Alb-23 (reference) and Alb-23 variants according to the invention

| SEQ ID NO: | Variant | Sequence |
|---|---|---|
| 61 | Alb-23 (WO 12/175400) | EVQLLESGGGLVQPGGSLRLSCAASGFTFRSF GMSWVRQAPGKGPEWVSSISGSGSDTLYADSV KGRFTISRDNSKNTLYLQMNSLRPEDTAVYYC TIGGSLSRSSQGTLVTVSS |
| 505 | 89L + 110K | EVQLLESGGGLVQPGGSLRLSCAASGFTFRSF GMSWVRQAPGKGPEWVSSISGSGSDTLYADSV KGRFTISRDNSKNTLYLQMNSLRPEDTALYYC TIGGSLSRSSQGTLVKVSS |
| 506 | 89L + 110Q | EVQLLESGGGLVQPGGSLRLSCAASGFTFRSF GMSWVRQAPGKGPEWVSSISGSGSDTLYADSV KGRFTISRDNSKNTLYLQMNSLRPEDTALYYC TIGGSLSRSSQGTLVQVSS |
| 507 | 110K | EVQLLESGGGLVQPGGSLRLSCAASGFTFRSF GMSWVRQAPGKGPEWVSSISGSGSDTLYADSV KGRFTISRDNSKNTLYLQMNSLRPEDTAVYYC TIGGSLSRSSQGTLVKVSS |

TABLE EE-continued

Alb-23 (reference) and Alb-23 variants according to the invention

| SEQ ID NO: | Variant | Sequence |
|---|---|---|
| 508 | 110Q | EVQLLESGGGLVQPGGSLRLSCAASGFTFRSF GMSWVRQAPGKGPEWVSSISGSGSDTLYADSV KGRFTISRDNSKNTLYLQMNSLRPEDTAVYYC TIGGSLSRSSQGTLVQVSS |
| 62 | 112K | EVQLLESGGGLVQPGGSLRLSCAASGFTFRSF GMSWVRQAPGKGPEWVSSISGSGSDTLYADSV KGRFTISRDNSKNTLYLQMNSLRPEDTAVYYC TIGGSLSRSSQGTLVTVKS |
| 69 | 112Q | EVQLLESGGGLVQPGGSLRLSCAASGFTFRSF GMSWVRQAPGKGPEWVSSISGSGSDTLYADSV KGRFTISRDNSKNTLYLQMNSLRPEDTAVYYC TIGGSLSRSSQGTLVTVQS |
| 86 | 89T | EVQLLESGGGLVQPGGSLRLSCAASGFTFRSF GMSWVRQAPGKGPEWVSSISGSGSDTLYADSV KGRFTISRDNSKNTLYLQMNSLRPEDTATYYC TIGGSLSRSSQGTLVTVSS |
| 116 | 11V + 89L | EVQLLESGGGVVQPGGSLRLSCAASGFTFRSF GMSWVRQAPGKGPEWVSSISGSGSDTLYADSV KGRFTISRDNSKNTLYLQMNSLRPEDTALYYC TIGGSLSRSSQGTLVTVSS |
| 130 | 11V + 89L + 110K | EVQLLESGGGVVQPGGSLRLSCAASGFTFRSF GMSWVRQAPGKGPEWVSSISGSGSDTLYADSV KGRFTISRDNSKNTLYLQMNSLRPEDTALYYC TIGGSLSRSSQGTLVKVSS |
| 509 | 11V + 89L + 110Q | EVQLLESGGGVVQPGGSLRLSCAASGFTFRSF GMSWVRQAPGKGPEWVSSISGSGSDTLYADSV KGRFTISRDNSKNTLYLQMNSLRPEDTALYYC TIGGSLSRSSQGTLVQVSS |
| 510 | 11V + 110K | EVQLLESGGGVVQPGGSLRLSCAASGFTFRSF GMSWVRQAPGKGPEWVSSISGSGSDTLYADSV KGRFTISRDNSKNTLYLQMNSLRPEDTAVYYC TIGGSLSRSSQGTLVKVSS |
| 511 | 11V + 110Q | EVQLLESGGGVVQPGGSLRLSCAASGFTFRSF GMSWVRQAPGKGPEWVSSISGSGSDTLYADSV KGRFTISRDNSKNTLYLQMNSLRPEDTAVYYC TIGGSLSRSSQGTLVQVSS |
| 512 | 11V + 112K | EVQLLESGGGVVQPGGSLRLSCAASGFTFRSF GMSWVRQAPGKGPEWVSSISGSGSDTLYADSV KGRFTISRDNSKNTLYLQMNSLRPEDTAVYYC TIGGSLSRSSQGTLVTVKS |
| 513 | 11V + 112Q | EVQLLESGGGVVQPGGSLRLSCAASGFTFRSF GMSWVRQAPGKGPEWVSSISGSGSDTLYADSV KGRFTISRDNSKNTLYLQMNSLRPEDTAVYYC TIGGSLSRSSQGTLVTVQS |

SEQUENCE LISTING (766 sequences)

SEQ ID NO: 1 - protein, 5 aa, Artificial Sequence
  C-terminal amino acid sequence
VTVKS

SEQ ID NO: 2 - protein, 5 aa, Artificial Sequence
  C-terminal amino acid sequence
VTVQS

SEQ ID NO: 3 - protein, 11 aa, Artificial Sequence
  FR4 sequence
WGQGTQVTVKS

SEQ ID NO: 4 - protein, 11 aa, Artificial Sequence
  FR4 sequence
WGKGTLVTVKS

SEQ ID NO: 5 - protein, 11 aa, Artificial Sequence
  FR4 sequence
RGQGTRVTVKS

SEQ ID NO: 6 - protein, 11 aa, Artificial Sequence
  FR4 sequence
WGLGTQVTISS

SEQ ID NO: 7 - protein, 11 aa, Artificial Sequence
  FR4 sequence
GSQGTQVTVKS

SEQ ID NO: 8 - protein, 11 aa, Artificial Sequence
  FR4 sequence
LRGGTQVTVKS

SEQ ID NO: 9 - protein, 11 aa, Artificial Sequence
  FR4 sequence
RGQGTLVTVKS

SEQ ID NO: 10 - protein, 11 aa, Artificial Sequence
  FR4 sequence
RSRGIQVTVKS

SEQ ID NO: 11 - protein, 11 aa, Artificial Sequence
  FR4 sequence
WGKGTQVTVKS

SEQ ID NO: 12 - protein, 11 aa, Artificial Sequence
  FR4 sequence
WGQGTQVTVQS

SEQ ID NO: 13 - protein, 11 aa, Artificial Sequence
  FR4 sequence
WGKGTLVTVQS

SEQ ID NO: 14 - protein, 11 aa, Artificial Sequence
  FR4 sequence
RGQGTRVTVQS

SEQ ID NO: 15 - protein, 11 aa, Artificial Sequence
  FR4 sequence
WGLGTQVTISS

SEQ ID NO: 16 - protein, 11 aa, Artificial Sequence
  FR4 sequence
GSQGTQVTVQS

SEQ ID NO: 17 - protein, 11 aa, Artificial Sequence
  FR4 sequence
LRGGTQVTVQS

SEQ ID NO: 18 - protein, 11 aa, Artificial Sequence
  FR4 sequence
RGQGTLVTVQS

SEQ ID NO: 19 - protein, 11 aa, Artificial Sequence
  FR4 sequence
RSRGIQVTVQS

SEQ ID NO: 20 - protein, 11 aa, Artificial Sequence
  FR4 sequence
WGKGTQVTVQS

SEQ ID NO: 21 - protein, 6 aa, Artificial Sequence
  C-terminal amino acid sequence
  SITE (6)..(6): Xaa stands for (X)n which means C-terminal extension with n amino acids, wherein each position is chosen independently from any amino acids
VTVKSX

SEQ ID NO: 22 - protein, 6 aa, Artificial Sequence
  C-terminal amino acid sequence
  SITE (6)..(6): Xaa stands for (X)n which means C-terminal extension with n amino acids, wherein each position is chosen independently from any amino acids
VTVQSX

SEQ ID NO: 23 - protein, 12 aa, Artificial Sequence
  FR4 sequence
  SITE (12)..(12): Xaa stands for (X)n which means C-terminal extension with n amino acids, wherein each position is chosen independently from any amino acids
WGQGTQVTVKSX

SEQ ID NO: 24 - protein, 12 aa, Artificial Sequence
  FR4 sequence
  SITE (12)..(12): Xaa stands for (X)n which means C-terminal extension with n amino acids, wherein each position is chosen independently from any amino acids
WGKGTLVTVKSX

SEQ ID NO: 25 - protein, 12 aa, Artificial Sequence
  FR4 sequence
  SITE (12)..(12): Xaa stands for (X)n which means C-terminal extension with n amino acids, wherein each position is chosen independently from any amino acids
RGQGTRVTVKSX

SEQ ID NO: 26 - protein, 12 aa, Artificial Sequence
  FR4 sequence
  SITE (12)..(12): Xaa stands for (X)n which means C-terminal extension with n amino acids, wherein each position is chosen independently from any amino acids
WGLGTQVTISSX

SEQ ID NO: 27 - protein, 12 aa, Artificial Sequence
  FR4 sequence
  SITE (12)..(12): Xaa stands for (X)n which means C-terminal extension with n amino acids, wherein each position is chosen independently from any amino acids
GSQGTQVTVKSX

SEQ ID NO: 28 - protein, 12 aa, Artificial Sequence
  FR4 sequence
  SITE (12)..(12): Xaa stands for (X)n which means C-terminal extension with n amino acids, wherein each position is chosen independently from any amino acids
LRGGTQVTVKSX

SEQ ID NO: 29 - protein, 12 aa, Artificial Sequence
  FR4 sequence
  SITE (12)..(12): Xaa stands for (X)n which means C-terminal extension with n amino acids, wherein each position is chosen independently from any amino acids
RGQGTLVTVKSX

SEQ ID NO: 30 - protein, 12 aa, Artificial Sequence
  FR4 sequence
  SITE (12)..(12): Xaa stands for (X)n which means C-terminal extension with n amino acids, wherein each position is chosen independently from any amino acids
RSRGIQVTVKSX

SEQ ID NO: 31 - protein, 12 aa, Artificial Sequence
  FR4 sequence
  SITE (12)..(12): Xaa stands for (X)n which means C-terminal extension with n amino acids, wherein each position is chosen independently from any amino acids
WGKGTQVTVKSX

SEQ ID NO: 32 - protein, 12 aa, Artificial Sequence
  FR4 sequence
  SITE (12)..(12): Xaa stands for (X)n which means C-terminal extension with n amino acids, wherein each position is chosen independently from any amino acids
WGQGTQVTVQSX

SEQ ID NO: 33 - protein, 12 aa, Artificial Sequence
  FR4 sequence
  SITE (12)..(12): Xaa stands for (X)n which means C-terminal extension with n amino acids, wherein each position is chosen independently from any amino acids
WGKGTLVTVQSX

SEQ ID NO: 34 - protein, 12 aa, Artificial Sequence
  FR4 sequence
  SITE (12)..(12): Xaa stands for (X)n which means C-terminal extension with n amino acids, wherein each position is chosen independently from any amino acids
RGQGTRVTVQSX

SEQ ID NO: 35 - protein, 12 aa, Artificial Sequence
  FR4 sequence
  SITE (12)..(12): Xaa stands for (X)n which means C-terminal extension with n amino acids, wherein each position is chosen independently from any amino acids
WGLGTQVTISSX

SEQ ID NO: 36 - protein, 12 aa, Artificial Sequence
  FR4 sequence
  SITE (12)..(12): Xaa stands for (X)n which means C-terminal extension with n amino acids, wherein each position is chosen independently from any amino acids
GSQGTQVTVQSX

SEQ ID NO: 37 - protein, 12 aa, Artificial Sequence
  FR4 sequence
  SITE (12)..(12): Xaa stands for (X)n which means C-terminal extension with n amino acids, wherein each position is chosen independently from any amino acids
LRGGTQVTVQSX

SEQ ID NO: 38 - protein, 12 aa, Artificial Sequence
  FR4 sequence
  SITE (12)..(12): Xaa stands for (X)n which means C-terminal extension with n amino acids, wherein each position is chosen independently from any amino acids
RGQGTLVTVQSX

SEQ ID NO: 39 - protein, 12 aa, Artificial Sequence
  FR4 sequence
  SITE (12)..(12): Xaa stands for (X)n which means C-terminal extension with n amino acids, wherein each position is chosen independently from any amino acids
RSRGIQVTVQSX

SEQ ID NO: 40 - protein, 12 aa, Artificial Sequence
  FR4 sequence
  SITE (12)..(12): Xaa stands for (X)n which means C-terminal extension with n amino acids, wherein each position is chosen independently from any amino acids
WGKGTQVTVQSX

SEQ ID NO: 41 - protein, 5 aa, Artificial Sequence
  CDR sequence
SFGMS

SEQ ID NO: 42 - protein, 17 aa, Artificial Sequence
  CDR sequence
SISGSGSDTLYADSVKG

SEQ ID NO: 43 - protein, 6 aa, Artificial Sequence
  CDR sequence
GGSLSR

SEQ ID NO: 44 - protein, 121 aa, Artificial Sequence
  Nanobody sequence
HHHHHHEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 45 - protein, 122 aa, Artificial Sequence
  Nanobody sequence
HHHHHHEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSA

SEQ ID NO: 46 - protein, 115 aa, Artificial Sequence [sequence omitted]

SEQ ID NO: 47 - protein, 115 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVKS

SEQ ID NO: 48 - protein, 116 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVKSA

SEQ ID NO: 49 - protein, 117 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVKSAA

SEQ ID NO: 50 - protein, 118 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVKSAAA

SEQ ID NO: 51 - protein, 116 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVKSG

SEQ ID NO: 52 - protein, 117 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVKSGG

SEQ ID NO: 53 - protein, 118 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVKSGGG

SEQ ID NO: 54 - protein, 115 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVQS

SEQ ID NO: 55 - protein, 116 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVQSA

SEQ ID NO: 56 - protein, 117 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVQSAA

SEQ ID NO: 57 - protein, 118 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVQSAAA

SEQ ID NO: 58 - protein, 116 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVQSG

SEQ ID NO: 59 - protein, 117 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVQSGG

SEQ ID NO: 60 - protein, 118 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVQSGGG

SEQ ID NO: 61 - protein, 115 aa, Artificial Sequence [sequence omitted]

SEQ ID NO: 62 - protein, 115 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVKS

SEQ ID NO: 63 - protein, 116 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVKSA

SEQ ID NO: 64 - protein, 117 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVKSAA

SEQ ID NO: 65 - protein, 118 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVKSAAA

SEQ ID NO: 66 - protein, 116 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVKSG

SEQ ID NO: 67 - protein, 117 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVKSGG

SEQ ID NO: 68 - protein, 118 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVKSGGG

SEQ ID NO: 69 - protein, 115 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVQS

SEQ ID NO: 70 - protein, 116 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVQSA

SEQ ID NO: 71 - protein, 117 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVQSAA

SEQ ID NO: 72 - protein, 118 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVQSAAA

SEQ ID NO: 73 - protein, 116 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVQSG

SEQ ID NO: 74 - protein, 117 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVQSGG

SEQ ID NO: 75 - protein, 118 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVQSGGG

SEQ ID NO: 76 - protein, 5 aa, Artificial Sequence
  C-terminal sequence
VTVSS

SEQ ID NO: 77 - protein, 6 aa, Artificial Sequence
  C-terminal sequence
  SITE (6)..(6): Xaa stands for (X)n which means C-terminal extension with n amino acids, wherein each position is chosen independently from any amino acids
VTVSSX

SEQ ID NO: 78 - protein, 115 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTATYYCTIGGSLSRSSQGTLVTVSS

SEQ ID NO: 79 - protein, 116 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTATYYCTIGGSLSRSSQGTLVTVSSA

SEQ ID NO: 80 - protein, 117 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTATYYCTIGGSLSRSSQGTLVTVSSAA

SEQ ID NO: 81 - protein, 118 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTATYYCTIGGSLSRSSQGTLVTVSSAAA

SEQ ID NO: 82 - protein, 116 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTATYYCTIGGSLSRSSQGTLVTVSSG

SEQ ID NO: 83 - protein, 117 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTATYYCTIGGSLSRSSQGTLVTVSSGG

SEQ ID NO: 84 - protein, 118 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTATYYCTIGGSLSRSSQGTLVTVSSGGG

SEQ ID NO: 85 - protein, 115 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTATYYCTIGGSLSRSSQGTLVTVSS

SEQ ID NO: 86 - protein, 116 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTATYYCTIGGSLSRSSQGTLVTVSSA

SEQ ID NO: 87 - protein, 117 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTATYYCTIGGSLSRSSQGTLVTVSSAA

SEQ ID NO: 88 - protein, 118 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTATYYCTIGGSLSRSSQGTLVTVSSAAA

SEQ ID NO: 89 - protein, 116 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTATYYCTIGGSLSRSSQGTLVTVSSG

SEQ ID NO: 90 - protein, 117 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTATYYCTIGGSLSRSSQGTLVTVSSGG

SEQ ID NO: 91 - protein, 118 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTATYYCTIGGSLSRSSQGTLVTVSSGGG

SEQ ID NO: 92 - protein, 128 aa, Artificial Sequence
  Nanobody sequence
EVQLVESGGGLVQPGGSLRLSCAASGRTFNNYAMGWFRQAPGKEREFVAAITRSGVRSGVSAIYGDSVKDRFTISRDNAKNTLYLQMNSLRPEDTAVYYCAASAIGSGALRRFEYDYSGQGTLVTVSS

SEQ ID NO: 93 - protein, 115 aa, Artificial Sequence [sequence omitted]

SEQ ID NO: 94 - protein, 117 aa, Artificial Sequence
  Nanobody sequence
EVQLVESGGGLVQPGGSLRLSCAASRSIGRLDRMGWYRHRPGEPRELVATITGGSSINYGDSVKGRFTISIDNSKNTVYLQMNSLRPEDTAVYYCNFNKYVTSRDTWGQGTLVTVSS

SEQ ID NO: 95 - protein, 5 aa, Artificial Sequence
  C-terminal amino acid sequence
VKVSS

SEQ ID NO: 96 - protein, 5 aa, Artificial Sequence
  C-terminal amino acid sequence
VQVSS

SEQ ID NO: 97 - protein, 6 aa, Artificial Sequence
  C-terminal amino acid sequence
  SITE (6)..(6): Xaa stands for (X)n which means C-terminal extension with n amino acids, wherein each position is chosen independently from any amino acids
VKVSSX

SEQ ID NO: 98 - protein, 6 aa, Artificial Sequence
  C-terminal amino acid sequence
  SITE (6)..(6): Xaa stands for (X)n which means C-terminal extension with n amino acids, wherein each position is chosen independently from any amino acids
VQVSSX

SEQ ID NO: 99 - protein, 11 aa, Artificial Sequence
  FR4 sequence
SSQGTLVTVKS

SEQ ID NO: 100 - protein, 11 aa, Artificial Sequence
  FR4 sequence
SSQGTLVTVQS

SEQ ID NO: 101 - protein, 11 aa, Artificial Sequence
  FR4 sequence
SSQGTLVKVSS

SEQ ID NO: 102 - protein, 11 aa, Artificial Sequence
  FR4 sequence
SSQGTLVQVSS

SEQ ID NO: 103 - protein, 12 aa, Artificial Sequence
  FR4 sequence
  SITE (12)..(12): Xaa stands for (X)n which means C-terminal extension with n amino acids, wherein each position is chosen independently from any amino acids
SSQGTLVTVKSX

SEQ ID NO: 104 - protein, 12 aa, Artificial Sequence
  FR4 sequence
  SITE (12)..(12): Xaa stands for (X)n which means C-terminal extension with n amino acids, wherein each position is chosen independently from any amino acids
SSQGTLVTVQSX

SEQ ID NO: 105 - protein, 12 aa, Artificial Sequence
  FR4 sequence
  SITE (12)..(12): Xaa stands for (X)n which means C-terminal extension with n amino acids, wherein each position is chosen independently from any amino acids
SSQGTLVKVSSX

SEQ ID NO: 106 - protein, 12 aa, Artificial Sequence
  FR4 sequence
  SITE (12)..(12): Xaa stands for (X)n which means C-terminal extension with n amino acids, wherein each position is chosen independently from any amino acids
SSQGTLVQVSSX

SEQ ID NO: 107 - protein, 5 aa, Artificial Sequence
  C-terminal amino acid sequence
  SITE (2)..(2): X is independently K or Q
  SITE (4)..(4): X is independently K or Q
VXVXS

SEQ ID NO: 108 - protein, 6 aa, Artificial Sequence
  C-terminal amino acid sequence
  SITE (2)..(2): X is independently K or Q
  SITE (4)..(4): X is independently K or Q
  SITE (6)..(6): Xaa stands for (X)n which means C-terminal extension with n amino acids, wherein each position is chosen independently from any amino acids
VXVXSX

SEQ ID NO: 109 - protein, 115 aa, Artificial Sequence
  Nanobody sequence
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSS

SEQ ID NO: 110 - protein, 116 aa, Artificial Sequence
  Nanobody sequence
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA

SEQ ID NO: 111 - protein, 117 aa, Artificial Sequence
  Nanobody sequence
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSAA

SEQ ID NO: 112 - protein, 118 aa, Artificial Sequence
  Nanobody sequence
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSAAA

SEQ ID NO: 113 - protein, 116 aa, Artificial Sequence
  Nanobody sequence
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSG

SEQ ID NO: 114 - protein, 117 aa, Artificial Sequence
  Nanobody sequence
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGG

SEQ ID NO: 115 - protein, 118 aa, Artificial Sequence
  Nanobody sequence
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGG

SEQ ID NO: 116 - protein, 115 aa, Artificial Sequence
  Nanobody sequence
EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSS

SEQ ID NO: 117 - protein, 116 aa, Artificial Sequence
  Nanobody sequence
EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSA

SEQ ID NO: 118 - protein, 117 aa, Artificial Sequence
  Nanobody sequence
EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSAA

SEQ ID NO: 119 - protein, 118 aa, Artificial Sequence
  Nanobody sequence
EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSAAA

SEQ ID NO: 120 - protein, 116 aa, Artificial Sequence
  Nanobody sequence
EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSG

SEQ ID NO: 121 - protein, 117 aa, Artificial Sequence
  Nanobody sequence
EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSGG

SEQ ID NO: 122 - protein, 118 aa, Artificial Sequence
  Nanobody sequence
EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSGGG

SEQ ID NO: 123 - protein, 115 aa, Artificial Sequence
  Nanobody sequence
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSS

SEQ ID NO: 124 - protein, 116 aa, Artificial Sequence
  Nanobody sequence
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSA

SEQ ID NO: 125 - protein, 117 aa, Artificial Sequence
  Nanobody sequence
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSAA

SEQ ID NO: 126 - protein, 118 aa, Artificial Sequence
  Nanobody sequence
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSAAA

SEQ ID NO: 127 - protein, 116 aa, Artificial Sequence
  Nanobody sequence
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSG

SEQ ID NO: 128 - protein, 117 aa, Artificial Sequence
  Nanobody sequence
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGG

SEQ ID NO: 129 - protein, 118 aa, Artificial Sequence
  Nanobody sequence
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGG

SEQ ID NO: 130 - protein, 115 aa, Artificial Sequence
  Nanobody sequence
EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSS

SEQ ID NO: 131 - protein, 116 aa, Artificial Sequence
  Nanobody sequence
EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSA

SEQ ID NO: 132 - protein, 117 aa, Artificial Sequence
  Nanobody sequence
EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSAA

SEQ ID NO: 133 - protein, 118 aa, Artificial Sequence
  Nanobody sequence
EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSAAA

SEQ ID NO: 134 - protein, 116 aa, Artificial Sequence
  Nanobody sequence
EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSG

SEQ ID NO: 135 - protein, 117 aa, Artificial Sequence
  Nanobody sequence
EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSGG

SEQ ID NO: 136 - protein, 118 aa, Artificial Sequence
  Nanobody sequence
EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSGGG

SEQ ID NO: 137 - protein, 116 aa, Artificial Sequence
  Nanobody sequence
EVQLVESGGGLVQAGGSLGLSCSASGLLFSRNSAGWYRQAPGKQREFVARIRMGGSINYADTVKGRFTISRDNAKNTVYLQMNSLKPEDTAVYYCSSWRTGFYEYWGQGTLVTVSS

SEQ ID NO: 138 - protein, 116 aa, Artificial Sequence
  Nanobody sequence
DVQLVESGGGVVQPGGSLRLSCSASGLLFSRNSAGWYRQAPGKQREFVARIRAGGSINYADSVKGRFTISRDNSKNTVYLQMNSLRPEDTALYYCSGWRTGFYEYWGQGTLVTVSS

SEQ ID NO: 139 - protein, 116 aa, Artificial Sequence
  Nanobody sequence
DVQLVESGGGVVQPGGSLRLSCSASGLLFSRNSAGWYRQAPGKQREFVARIRAGGSINYADSVKGRFTISRDNSKNTVYLQMNSLRPEDTALYYCSSWREGFYEYWGQGTLVTVSS

SEQ ID NO: 140 - protein, 116 aa, Artificial Sequence
  Nanobody sequence
DVQLVESGGGVVQPGGSLRLSCSASGLLFSRNSAGWYRQAPGKQREFVARIRAGGSINYADSVKGRFTISRDNSKNTVYLQMNSLRPEDTALYYCSGWREGFYEYWGQGTLVTVSS

SEQ ID NO: 141 - protein, 116 aa, Artificial Sequence
  Nanobody sequence
DVQLVESGGGVVQPGGSLRLSCSASGLLFSRNSAGWYRQAPGKQREFVARIRQGGSINYADSVKGRFTISRDNSKNTVYLQMNSLRPEDTALYYCSGWRTGFYEYWGQGTLVTVSS

SEQ ID NO: 142 - protein, 116 aa, Artificial Sequence
  Nanobody sequence
DVQLVESGGGVVQPGGSLRLSCSASGLLFSRNSAGWYRQAPGKQREFVARIRQGGSINYADSVKGRFTISRDNSKNTVYLQMNSLRPEDTALYYCSSWREGFYEYWGQGTLVTVSS

SEQ ID NO: 143 - protein, 116 aa, Artificial Sequence
  Nanobody sequence
DVQLVESGGGVVQPGGSLRLSCSASGLLFSRNSAGWYRQAPGKQREFVARIRQGGSINYADSVKGRFTISRDNSKNTVYLQMNSLRPEDTALYYCSGWREGFYEYWGQGTLVTVSS

SEQ ID NO: 144 - protein, 116 aa, Artificial Sequence
  Nanobody sequence
DVQLVESGGGVVQPGGSLRLSCSASGLLFSRNSAGWYRQAPGKQREFVARIRYGGSINYADSVKGRFTISRDNSKNTVYLQMNSLRPEDTALYYCSGWRTGFYEYWGQGTLVTVSS

SEQ ID NO: 145 - protein, 116 aa, Artificial Sequence
  Nanobody sequence
DVQLVESGGGVVQPGGSLRLSCSASGLLFSRNSAGWYRQAPGKQREFVARIRYGGSINYADSVKGRFTISRDNSKNTVYLQMNSLRPEDTALYYCSSWREGFYEYWGQGTLVTVSS

SEQ ID NO: 146 - protein, 116 aa, Artificial Sequence
  Nanobody sequence
DVQLVESGGGVVQPGGSLRLSCSASGLLFSRNSAGWYRQAPGKQREFVARIRYGGSINYADSVKGRFTISRDNSKNTVYLQMNSLRPEDTALYYCSGWREGFYEYWGQGTLVTVSS

SEQ ID NO: 147 - protein, 116 aa, Artificial Sequence
  Nanobody sequence
EVQLVESGGGVVQPGGSLRLSCSASGLLFSRNSAGWYRQAPGKQREFVARIRAGGSINYADSVKGRFTISRDNSKNTVYLQMNSLRPEDTALYYCSGWRTGFYEYWGQGTLVTVSS

SEQ ID NO: 148 - protein, 116 aa, Artificial Sequence
  Nanobody sequence
EVQLVESGGGVVQPGGSLRLSCSASGLLFSRNSAGWYRQAPGKQREFVARIRAGGSINYADSVKGRFTISRDNSKNTVYLQMNSLRPEDTALYYCSSWREGFYEYWGQGTLVTVSS

SEQ ID NO: 149 - protein, 116 aa, Artificial Sequence
  Nanobody sequence
EVQLVESGGGVVQPGGSLRLSCSASGLLFSRNSAGWYRQAPGKQREFVARIRAGGSINYADSVKGRFTISRDNSKNTVYLQMNSLRPEDTALYYCSGWREGFYEYWGQGTLVTVSS

SEQ ID NO: 150 - protein, 116 aa, Artificial Sequence
  Nanobody sequence
EVQLVESGGGVVQPGGSLRLSCSASGLLFSRNSAGWYRQAPGKQREFVARIRQGGSINYADSVKGRFTISRDNSKNTVYLQMNSLRPEDTALYYCSGWRTGFYEYWGQGTLVTVSS

SEQ ID NO: 151 - protein, 116 aa, Artificial Sequence
  Nanobody sequence
EVQLVESGGGVVQPGGSLRLSCSASGLLFSRNSAGWYRQAPGKQREFVARIRQGGSINYADSVKGRFTISRDNSKNTVYLQMNSLRPEDTALYYCSSWREGFYEYWGQGTLVTVSS

SEQ ID NO: 152 - protein, 116 aa, Artificial Sequence
  Nanobody sequence
EVQLVESGGGVVQPGGSLRLSCSASGLLFSRNSAGWYRQAPGKQREFVARIRQGGSINYADSVKGRFTISRDNSKNTVYLQMNSLRPEDTALYYCSGWREGFYEYWGQGTLVTVSS

SEQ ID NO: 153 - protein, 116 aa, Artificial Sequence
  Nanobody sequence
EVQLVESGGGVVQPGGSLRLSCSASGLLFSRNSAGWYRQAPGKQREFVARIRYGGSINYADSVKGRFTISRDNSKNTVYLQMNSLRPEDTALYYCSGWRTGFYEYWGQGTLVTVSS

SEQ ID NO: 154 - protein, 116 aa, Artificial Sequence
  Nanobody sequence
EVQLVESGGGVVQPGGSLRLSCSASGLLFSRNSAGWYRQAPGKQREFVARIRYGGSINYADSVKGRFTISRDNSKNTVYLQMNSLRPEDTALYYCSSWREGFYEYWGQGTLVTVSS

SEQ ID NO: 155 - protein, 116 aa, Artificial Sequence
  Nanobody sequence
EVQLVESGGGVVQPGGSLRLSCSASGLLFSRNSAGWYRQAPGKQREFVARIRYGGSINYADSVKGRFTISRDNSKNTVYLQMNSLRPEDTALYYCSGWREGFYEYWGQGTLVTVSS

SEQ ID NO: 156 - protein, 418 aa, Artificial Sequence
  Nanobody construct
DVQLVESGGGVVQPGGSLRLSCSASGLLFSRNSAGWYRQAPGKQREFVARIRQGGSINYADSVKGRFTISRDNSKNTVYLQMNSLRPEDTALYYCSGWRTGFYEYWGQGTLVTVSSGGGGSGGGGSGGGGSGGGGSGGGGSGGGGSGGGGSEVQLVESGGGVVQPGGSLRLSCSASGLLFSRNSAGWYRQAPGKQREFVARIRQGGSINYADSVKGRFTISRDNSKNTVYLQMNSLRPEDTALYYCSGWRTGFYEYWGQGTLVTVSSGGGGSGGGGSGGGGSGGGGSGGGGSGGGGSGGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA

SEQ ID NO: 157 - protein, 418 aa, Artificial Sequence
  Nanobody construct
DVQLVESGGGVVQPGGSLRLSCSASGLLFSRNSAGWYRQAPGKQREFVARIRQGGSINYADSVKGRFTISRDNSKNTVYLQMNSLRPEDTALYYCSSWREGFYEYWGQGTLVTVSSGGGGSGGGGSGGGGSGGGGSGGGGSGGGGSGGGGSEVQLVESGGGVVQPGGSLRLSCSASGLLFSRNSAGWYRQAPGKQREFVARIRQGGSINYADSVKGRFTISRDNSKNTVYLQMNSLRPEDTALYYCSSWREGFYEYWGQGTLVTVSSGGGGSGGGGSGGGGSGGGGSGGGGSGGGGSGGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA

SEQ ID NO: 158 - protein, 418 aa, Artificial Sequence
  Nanobody construct
DVQLVESGGGVVQPGGSLRLSCSASGLLFSRNSAGWYRQAPGKQREFVARIRAGGSINYADSVKGRFTISRDNSKNTVYLQMNSLRPEDTALYYCSGWRTGFYEYWGQGTLVTVSSGGGGSGGGGSGGGGSGGGGSGGGGSGGGGSGGGGSEVQLVESGGGVVQPGGSLRLSCSASGLLFSRNSAGWYRQAPGKQREFVARIRAGGSINYADSVKGRFTISRDNSKNTVYLQMNSLRPEDTALYYCSGWRTGFYEYWGQGTLVTVSSGGGGSGGGGSGGGGSGGGGSGGGGSGGGGSGGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA

SEQ ID NO: 159 - protein, 418 aa, Artificial Sequence
  Nanobody construct
DVQLVESGGGVVQPGGSLRLSCSASGLLFSRNSAGWYRQAPGKQREFVARIRAGGSINYADSVKGRFTISRDNSKNTVYLQMNSLRPEDTALYYCSSWREGFYEYWGQGTLVTVSSGGGGSGGGGSGGGGSGGGGSGGGGSGGGGSGGGGSEVQLVESGGGVVQPGGSLRLSCSASGLLFSRNSAGWYRQAPGKQREFVARIRAGGSINYADSVKGRFTISRDNSKNTVYLQMNSLRPEDTALYYCSSWREGFYEYWGQGTLVTVSSGGGGSGGGGSGGGGSGGGGSGGGGSGGGGSGGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA

SEQ ID NO: 160 - protein, 418 aa, Artificial Sequence
  Nanobody construct
DVQLVESGGGVVQPGGSLRLSCSASGLLFSRNSAGWYRQAPGKQREFVARIRAGGSINYADSVKGRFTISRDNSKNTVYLQMNSLRPEDTALYYCSGWREGFYEYWGQGTLVTVSSGGGGSGGGGSGGGGSGGGGSGGGGSGGGGSGGGGSEVQLVESGGGVVQPGGSLRLSCSASGLLFSRNSAGWYRQAPGKQREFVARIRAGGSINYADSVKGRFTISRDNSKNTVYLQMNSLRPEDTALYYCSGWREGFYEYWGQGTLVTVSSGGGGSGGGGSGGGGSGGGGSGGGGSGGGGSGGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA

SEQ ID NO: 161 - protein, 418 aa, Artificial Sequence
  Nanobody construct
DVQLVESGGGVVQPGGSLRLSCSASGLLFSRNSAGWYRQAPGKQREFVARIRYGGSINYADSVKGRFTISRDNSKNTVYLQMNSLRPEDTALYYCSGWRTGFYEYWGQGTLVTVSSGGGGSGGGGSGGGGSGGGGSGGGGSGGGGSGGGGSEVQLVESGGGVVQPGGSLRLSCSASGLLFSRNSAGWYRQAPGKQREFVARIRYGGSINYADSVKGRFTISRDNSKNTVYLQMNSLRPEDTALYYCSGWRTGFYEYWGQGTLVTVSSGGGGSGGGGSGGGGSGGGGSGGGGSGGGGSGGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA

SEQ ID NO: 162 - protein, 418 aa, Artificial Sequence
  Nanobody construct
DVQLVESGGGVVQPGGSLRLSCSASGLLFSRNSAGWYRQAPGKQREFVARIRYGGSINYADSVKGRFTISRDNSKNTVYLQMNSLRPEDTALYYCSSWREGFYEYWGQGTLVTVSSGGGGSGGGGSGGGGSGGGGSGGGGSGGGGSGGGGSEVQLVESGGGVVQPGGSLRLSCSASGLLFSRNSAGWYRQAPGKQREFVARIRYGGSINYADSVKGRFTISRDNSKNTVYLQMNSLRPEDTALYYCSSWREGFYEYWGQGTLVTVSSGGGGSGGGGSGGGGSGGGGSGGGGSGGGGSGGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA

SEQ ID NO: 163 - protein, 418 aa, Artificial Sequence
  Nanobody construct
DVQLVESGGGVVQPGGSLRLSCSASGLLFSRNSAGWYRQAPGKQREFVARIRYGGSINYADSVKGRFTISRDNSKNTVYLQMNSLRPEDTALYYCSGWREGFYEYWGQGTLVTVSSGGGGSGGGGSGGGGSGGGGSGGGGSGGGGSGGGGSEVQLVESGGGVVQPGGSLRLSCSASGLLFSRNSAGWYRQAPGKQREFVARIRYGGSINYADSVKGRFTISRDNSKNTVYLQMNSLRPEDTALYYCSGWREGFYEYWGQGTLVTVSSGGGGSGGGGSGGGGSGGGGSGGGGSGGGGSGGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA

SEQ ID NO: 164 - protein, 418 aa, Artificial Sequence
  Nanobody construct
DVQLVESGGGVVQPGGSLRLSCSASGLLFSRNSAGWYRQAPGKQREFVARIRQGGSINYADSVKGRFTISRDNSKNTVYLQMNSLRPEDTALYYCSGWREGFYEYWGQGTLVTVSSGGGGSGGGGSGGGGSGGGGSGGGGSGGGGSGGGGSEVQLVESGGGVVQPGGSLRLSCSASGLLFSRNSAGWYRQAPGKQREFVARIRQGGSINYADSVKGRFTISRDNSKNTVYLQMNSLRPEDTALYYCSGWREGFYEYWGQGTLVTVSSGGGGSGGGGSGGGGSGGGGSGGGGSGGGGSGGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA

SEQ ID NO: 165 - protein, 418 aa, Artificial Sequence
  Nanobody construct
DVQLVESGGGLVQAGGSLGLSCSASGLLFSRNSAGWYRQAPGKQREFVARIRMGGSINYADTVKGRFTISRDNAKNTVYLQMNSLKPEDTAVYYCSSWRTGFYEYWGQGTLVTVSSGGGGSGGGGSGGGGSGGGGSGGGGSGGGGSGGGGSEVQLVESGGGLVQAGGSLGLSCSASGLLFSRNSAGWYRQAPGKQREFVARIRMGGSINYADTVKGRFTISRDNAKNTVYLQMNSLKPEDTAVYYCSSWRTGFYEYWGQGTLVTVSSGGGGSGGGGSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSA

SEQ ID NO: 166 - protein, 5 aa, Artificial Sequence
  CDR sequence
RNSAG

SEQ ID NO: 167 - protein, 16 aa, Artificial Sequence
  CDR sequence
RIRMGGSINYADTVKG

SEQ ID NO: 168 - protein, 8 aa, Artificial Sequence
  CDR sequence
WRTGFYEY

SEQ ID NO: 169 - protein, 10 aa, Artificial Sequence
  CDR sequence
GLLFSRNSAG

SEQ ID NO: 170 - protein, 9 aa, Artificial Sequence
  CDR sequence
RIRMGGSIN

SEQ ID NO: 171 - protein, 8 aa, Artificial Sequence
  CDR sequence
WRTGFYEY

SEQ ID NO: 172 - protein, 125 aa, Artificial Sequence
  Nanobody sequence
EVQLLESGGGLVQPGGSLRLSCAASGRIFSLPASGNIFNLLTIAWYRQAPGKGRELVATINSGSRTYYADSVKGRFTISRDNSKKTVYLQMNSLRPEDTAVYYCQTSGSGSPNFWGQGTLVTVSS

SEQ ID NO: 173 - protein, 14 aa, Artificial Sequence
  CDR sequence
LPASGNIFNLLTIA

SEQ ID NO: 174 - protein, 26 aa, Artificial Sequence
  CDR sequence
APGKGRELVATINSGSRTYYADSVKG

SEQ ID NO: 175 - protein, 8 aa, Artificial Sequence
  CDR sequence
SGSGSPNF

SEQ ID NO: 176 - protein, 125 aa, Artificial Sequence
  Nanobody sequence
EVQLLESGGGLVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVKVSS

SEQ ID NO: 177 - protein, 125 aa, Artificial Sequence
  Nanobody sequence
EVQLLESGGGLVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVQVSS

SEQ ID NO: 178 - protein, 125 aa, Artificial Sequence
  Nanobody sequence
EVQLLESGGGLVQPGGSLRLSCAASGRIFSLPASGNIFNLLTIAWYRQAPGKGRELVATINSGSRTYYADSVKGRFTISRDNSKKTVYLQMNSLRPEDTAVYYCQTSGSGSPNFWGQGTLVKVSS

SEQ ID NO: 179 - protein, 125 aa, Artificial Sequence
  Nanobody sequence
EVQLLESGGGLVQPGGSLRLSCAASGRIFSLPASGNIFNLLTIAWYRQAPGKGRELVATINSGSRTYYADSVKGRFTISRDNSKKTVYLQMNSLRPEDTAVYYCQTSGSGSPNFWGQGTLVQVSS

SEQ ID NO: 180 - protein, 125 aa, Artificial Sequence
  Nanobody sequence
EVQLLESGGGLVQPGGSLRLSCAASGRIFSLPASGNIFNLLTIAWYRQAPGKGRELVATINSGSRTYYADSVKGRFTISRDNSKKTVYLQMNSLRPEDTAVYYCQTSGSGSPNFWGQGTLVTVKS

SEQ ID NO: 181 - protein, 125 aa, Artificial Sequence
  Nanobody sequence
EVQLLESGGGLVQPGGSLRLSCAASGRIFSLPASGNIFNLLTIAWYRQAPGKGRELVATINSGSRTYYADSVKGRFTISRDNSKKTVYLQMNSLRPEDTAVYYCQTSGSGSPNFWGQGTLVTVQS

SEQ ID NO: 182 - protein, 125 aa, Artificial Sequence
  Nanobody sequence
EVQLLESGGGLVQPGGSLRLSCAASGRIFSLPASGNIFNLLTIAWYRQAPGKGRELVATINSGSRTYYADSVKGRFTISRDNSKKTVYLQMNSLRPEDTATYYCQTSGSGSPNFWGQGTLVTVSS

SEQ ID NO: 183 - protein, 125 aa, Artificial Sequence
  Nanobody sequence
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVTVSS

SEQ ID NO: 184 - protein, 125 aa, Artificial Sequence
  Nanobody sequence
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVKVSS

SEQ ID NO: 185 - protein, 125 aa, Artificial Sequence
  Nanobody sequence
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVQVSS

SEQ ID NO: 186 - protein, 125 aa, Artificial Sequence
  Nanobody sequence
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTAVYYCQTSGSGSPNFWGQGTLVKVSS

SEQ ID NO: 187 - protein, 125 aa, Artificial Sequence
  Nanobody sequence
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTAVYYCQTSGSGSPNFWGQGTLVQVSS

SEQ ID NO: 188 - protein, 125 aa, Artificial Sequence
  Nanobody sequence
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTAVYYCQTSGSGSPNFWGQGTLVTVKS

SEQ ID NO: 189 - protein, 125 aa, Artificial Sequence
  Nanobody sequence
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTAVYYCQTSGSGSPNFWGQGTLVTVQS

SEQ ID NO: 190 - protein, 128 aa, Artificial Sequence
  Nanobody sequence
EVQLLESGGGLVQPGGSLRLSCAASGRTLSSYAMGWFRQAPGKGREFVARISQGGTAIYYADSVKGRFTISRDNSKNTLYLQMNSLRPEDTAVYYCAKDPSPYYRGSAYLLSGSYDSWGQGTLVTVSS

SEQ ID NO: 191 - protein, 5 aa, Artificial Sequence
  CDR sequence
SYAMG

SEQ ID NO: 192 - protein, 17 aa, Artificial Sequence
  CDR sequence
RISQGGTAIYYADSVKG

SEQ ID NO: 193 - protein, 19 aa, Artificial Sequence
  CDR sequence
DPSPYYRGSAYLLSGSYDS

SEQ ID NO: 194 - protein, 128 aa, Artificial Sequence
  Nanobody sequence
EVQLLESGGGLVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVKVSS

SEQ ID NO: 195 - protein, 128 aa, Artificial Sequence
  Nanobody sequence
EVQLLESGGGLVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVQVSS

SEQ ID NO: 196 - protein, 128 aa, Artificial Sequence
  Nanobody sequence
EVQLLESGGGLVQPGGSLRLSCAASGRTLSSYAMGWFRQAPGKGREFVARISQGGTAIYYADSVKGRFTISRDNSKNTLYLQMNSLRPEDTAVYYCAKDPSPYYRGSAYLLSGSYDSWGQGTLVKVSS

SEQ ID NO: 197 - protein, 128 aa, Artificial Sequence
  Nanobody sequence
EVQLLESGGGLVQPGGSLRLSCAASGRTLSSYAMGWFRQAPGKGREFVARISQGGTAIYYADSVKGRFTISRDNSKNTLYLQMNSLRPEDTAVYYCAKDPSPYYRGSAYLLSGSYDSWGQGTLVQVSS

SEQ ID NO: 198 - protein, 128 aa, Artificial Sequence
  Nanobody sequence
EVQLLESGGGLVQPGGSLRLSCAASGRTLSSYAMGWFRQAPGKGREFVARISQGGTAIYYADSVKGRFTISRDNSKNTLYLQMNSLRPEDTAVYYCAKDPSPYYRGSAYLLSGSYDSWGQGTLVTVKS

SEQ ID NO: 199 - protein, 128 aa, Artificial Sequence
  Nanobody sequence
EVQLLESGGGLVQPGGSLRLSCAASGRTLSSYAMGWFRQAPGKGREFVARISQGGTAIYYADSVKGRFTISRDNSKNTLYLQMNSLRPEDTAVYYCAKDPSPYYRGSAYLLSGSYDSWGQGTLVTVQS

SEQ ID NO: 200 - protein, 128 aa, Artificial Sequence
  Nanobody sequence
EVQLLESGGGLVQPGGSLRLSCAASGRTLSSYAMGWFRQAPGKGREFVARISQGGTAIYYADSVKGRFTISRDNSKNTLYLQMNSLRPEDTATYYCAKDPSPYYRGSAYLLSGSYDSWGQGTLVTVSS

SEQ ID NO: 201 - protein, 128 aa, Artificial Sequence
  Nanobody sequence
EVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVTVSS

SEQ ID NO: 202 - protein, 128 aa, Artificial Sequence
  Nanobody sequence
EVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVKVSS

SEQ ID NO: 203 - protein, 128 aa, Artificial Sequence
  Nanobody sequence
EVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVQVSS

SEQ ID NO: 204 - protein, 128 aa, Artificial Sequence
  Nanobody sequence
EVQLLESGGGVVQPGGSLRLSCAASGRTLSSYAMGWFRQAPGKGREFVARISQGGTAIYYADSVKGRFTISRDNSKNTLYLQMNSLRPEDTAVYYCAKDPSPYYRGSAYLLSGSYDSWGQGTLVKVSS

SEQ ID NO: 205 - protein, 128 aa, Artificial Sequence
  Nanobody sequence
EVQLLESGGGVVQPGGSLRLSCAASGRTLSSYAMGWFRQAPGKGREFVARISQGGTAIYYADSVKGRFTISRDNSKNTLYLQMNSLRPEDTAVYYCAKDPSPYYRGSAYLLSGSYDSWGQGTLVQVSS

SEQ ID NO: 206 - protein, 128 aa, Artificial Sequence
  Nanobody sequence
EVQLLESGGGVVQPGGSLRLSCAASGRTLSSYAMGWFRQAPGKGREFVARISQGGTAIYYADSVKGRFTISRDNSKNTLYLQMNSLRPEDTAVYYCAKDPSPYYRGSAYLLSGSYDSWGQGTLVTVKS

SEQ ID NO: 207 - protein, 128 aa, Artificial Sequence
  Nanobody sequence
EVQLLESGGGVVQPGGSLRLSCAASGRTLSSYAMGWFRQAPGKGREFVARISQGGTAIYYADSVKGRFTISRDNSKNTLYLQMNSLRPEDTAVYYCAKDPSPYYRGSAYLLSGSYDSWGQGTLVTVQS

SEQ ID NO: 208 - protein, 117 aa, Artificial Sequence; identical to SEQ ID NO: 94
  Nanobody sequence

SEQ ID NO: 209 - protein, 5 aa, Artificial Sequence
  CDR sequence
LDRMG

SEQ ID NO: 210 - protein, 16 aa, Artificial Sequence
  CDR sequence
TITGGSSINYGDSVKG

SEQ ID NO: 211 - protein, 9 aa, Artificial Sequence
  CDR sequence
NKYVTSRDT

SEQ ID NO: 212 - protein, 117 aa, Artificial Sequence
  Nanobody sequence
EVQLVESGGGLVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSS

SEQ ID NO: 213 - protein, 117 aa, Artificial Sequence
  Nanobody sequence
EVQLVESGGGLVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSS

SEQ ID NO: 214 - protein, 117 aa, Artificial Sequence
  Nanobody sequence
EVQLVESGGGLVQPGGSLRLSCAASRSIGRLDRMGWYRHRPGEPRELVATITGGSSINYGDSVKGRFTISIDNSKNTVYLQMNSLRPEDTAVYYCNFNKYVTSRDTWGQGTLVKVSS

SEQ ID NO: 215 - protein, 117 aa, Artificial Sequence
  Nanobody sequence
EVQLVESGGGLVQPGGSLRLSCAASRSIGRLDRMGWYRHRPGEPRELVATITGGSSINYGDSVKGRFTISIDNSKNTVYLQMNSLRPEDTAVYYCNFNKYVTSRDTWGQGTLVQVSS

SEQ ID NO: 216 - protein, 117 aa, Artificial Sequence
  Nanobody sequence
EVQLVESGGGLVQPGGSLRLSCAASRSIGRLDRMGWYRHRPGEPRELVATITGGSSINYGDSVKGRFTISIDNSKNTVYLQMNSLRPEDTAVYYCNFNKYVTSRDTWGQGTLVTVKS

SEQ ID NO: 217 - protein, 117 aa, Artificial Sequence
  Nanobody sequence
EVQLVESGGGLVQPGGSLRLSCAASRSIGRLDRMGWYRHRPGEPRELVATITGGSSINYGDSVKGRFTISIDNSKNTVYLQMNSLRPEDTAVYYCNFNKYVTSRDTWGQGTLVTVQS

SEQ ID NO: 218 - protein, 117 aa, Artificial Sequence
  Nanobody sequence
EVQLVESGGGLVQPGGSLRLSCAASRSIGRLDRMGWYRHRPGEPRELVATITGGSSINYGDSVKGRFTISIDNSKNTVYLQMNSLRPEDTATYYCNFNKYVTSRDTWGQGTLVTVSS

SEQ ID NO: 219 - protein, 117 aa, Artificial Sequence
  Nanobody sequence
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSS

SEQ ID NO: 220 - protein, 117 aa, Artificial Sequence
  Nanobody sequence
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSS

SEQ ID NO: 221 - protein, 117 aa, Artificial Sequence
  Nanobody sequence
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSS

SEQ ID NO: 222 - protein, 117 aa, Artificial Sequence
  Nanobody sequence
EVQLVESGGGVVQPGGSLRLSCAASRSIGRLDRMGWYRHRPGEPRELVATITGGSSINYGDSVKGRFTISIDNSKNTVYLQMNSLRPEDTAVYYCNFNKYVTSRDTWGQGTLVKVSS

SEQ ID NO: 223 - protein, 117 aa, Artificial Sequence
  Nanobody sequence
EVQLVESGGGVVQPGGSLRLSCAASRSIGRLDRMGWYRHRPGEPRELVATITGGSSINYGDSVKGRFTISIDNSKNTVYLQMNSLRPEDTAVYYCNFNKYVTSRDTWGQGTLVQVSS

SEQ ID NO: 224 - protein, 117 aa, Artificial Sequence
  Nanobody sequence
EVQLVESGGGVVQPGGSLRLSCAASRSIGRLDRMGWYRHRPGEPRELVATITGGSSINYGDSVKGRFTISIDNSKNTVYLQMNSLRPEDTAVYYCNFNKYVTSRDTWGQGTLVTVKS

SEQ ID NO: 225 - protein, 117 aa, Artificial Sequence
  Nanobody sequence
EVQLVESGGGVVQPGGSLRLSCAASRSIGRLDRMGWYRHRPGEPRELVATITGGSSINYGDSVKGRFTISIDNSKNTVYLQMNSLRPEDTAVYYCNFNKYVTSRDTWGQGTLVTVQS

SEQ ID NO: 226 - protein, 122 aa, Artificial Sequence
  Nanobody sequence
DVQLLESGGGLVQPGGSLRLSCAASGFTFGNYDMAWVRQAPGKRPEWVSSIDTGGDITHYADSVKGRFTISRDNAKNTLYLQMNSLRPEDTAVYWCATDEEYALGPNEFDYYGQGTLVTVSS

SEQ ID NO: 227 - protein, 5 aa, Artificial Sequence
  CDR sequence
NYDMA

SEQ ID NO: 228 - protein, 17 aa, Artificial Sequence
  CDR sequence
SIDTGGDITHYADSVKG

SEQ ID NO: 229 - protein, 13 aa, Artificial Sequence
  CDR sequence
DEEYALGPNEFDY

SEQ ID NO: 230 - protein, 122 aa, Artificial Sequence
  Nanobody sequence
DVQLLESGGGLVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVKVSS

SEQ ID NO: 231 - protein, 122 aa, Artificial Sequence
  Nanobody sequence
DVQLLESGGGLVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVQVSS

SEQ ID NO: 232 - protein, 122 aa, Artificial Sequence
  Nanobody sequence
DVQLLESGGGLVQPGGSLRLSCAASGFTFGNYDMAWVRQAPGKRPEWVSSIDTGGDITHYADSVKGRFTISRDNAKNTLYLQMNSLRPEDTAVYWCATDEEYALGPNEFDYYGQGTLVKVSS

SEQ ID NO: 233 - protein, 122 aa, Artificial Sequence
  Nanobody sequence
DVQLLESGGGLVQPGGSLRLSCAASGFTFGNYDMAWVRQAPGKRPEWVSSIDTGGDITHYADSVKGRFTISRDNAKNTLYLQMNSLRPEDTAVYWCATDEEYALGPNEFDYYGQGTLVQVSS

SEQ ID NO: 234 - protein, 122 aa, Artificial Sequence
  Nanobody sequence
DVQLLESGGGLVQPGGSLRLSCAASGFTFGNYDMAWVRQAPGKRPEWVSSIDTGGDITHYADSVKGRFTISRDNAKNTLYLQMNSLRPEDTAVYWCATDEEYALGPNEFDYYGQGTLVTVKS

SEQ ID NO: 235 - protein, 122 aa, Artificial Sequence
  Nanobody sequence
DVQLLESGGGLVQPGGSLRLSCAASGFTFGNYDMAWVRQAPGKRPEWVSSIDTGGDITHYADSVKGRFTISRDNAKNTLYLQMNSLRPEDTAVYWCATDEEYALGPNEFDYYGQGTLVTVQS

SEQ ID NO: 236 - protein, 122 aa, Artificial Sequence
  Nanobody sequence
DVQLLESGGGLVQPGGSLRLSCAASGFTFGNYDMAWVRQAPGKRPEWVSSIDTGGDITHYADSVKGRFTISRDNAKNTLYLQMNSLRPEDTATYWCATDEEYALGPNEFDYYGQGTLVTVSS

SEQ ID NO: 237 - protein, 122 aa, Artificial Sequence
  Nanobody sequence
DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVTVSS

SEQ ID NO: 238 - protein, 122 aa, Artificial Sequence
  Nanobody sequence
DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVKVSS

SEQ ID NO: 239 - protein, 122 aa, Artificial Sequence
  Nanobody sequence
DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVQVSS

SEQ ID NO: 240 - protein, 122 aa, Artificial Sequence
  Nanobody sequence
DVQLLESGGGVVQPGGSLRLSCAASGFTFGNYDMAWVRQAPGKRPEWVSSIDTGGDITHYADSVKGRFTISRDNAKNTLYLQMNSLRPEDTAVYWCATDEEYALGPNEFDYYGQGTLVKVSS

SEQ ID NO: 241 - protein, 122 aa, Artificial Sequence
  Nanobody sequence
DVQLLESGGGVVQPGGSLRLSCAASGFTFGNYDMAWVRQAPGKRPEWVSSIDTGGDITHYADSVKGRFTISRDNAKNTLYLQMNSLRPEDTAVYWCATDEEYALGPNEFDYYGQGTLVQVSS

SEQ ID NO: 242 - protein, 122 aa, Artificial Sequence
  Nanobody sequence
DVQLLESGGGVVQPGGSLRLSCAASGFTFGNYDMAWVRQAPGKRPEWVSSIDTGGDITHYADSVKGRFTISRDNAKNTLYLQMNSLRPEDTAVYWCATDEEYALGPNEFDYYGQGTLVTVKS

SEQ ID NO: 243 - protein, 122 aa, Artificial Sequence
  Nanobody sequence
DVQLLESGGGVVQPGGSLRLSCAASGFTFGNYDMAWVRQAPGKRPEWVSSIDTGGDITHYADSVKGRFTISRDNAKNTLYLQMNSLRPEDTAVYWCATDEEYALGPNEFDYYGQGTLVTVQS

SEQ ID NO: 244 - protein, 122 aa, Artificial Sequence
  Nanobody sequence
EVQLVESGGGLVQPGGSLRLSCAASGFTFSSYAMSWVRQAPGKGLEWVSGIKSSGDSTRYAGSVKGRFTISRDNAKNTLYLQMNSLRPEDTAVYYCAKSRVSRTGLYTYDNRGQGTLVTVSS

SEQ ID NO: 245 - protein, 5 aa, Artificial Sequence
  CDR sequence
SYAMS

SEQ ID NO: 246 - protein, 17 aa, Artificial Sequence
  CDR sequence
GIKSSGDSTRYAGSVKG

SEQ ID NO: 247 - protein, 13 aa, Artificial Sequence
  CDR sequence
SRVSRTGLYTYDN

SEQ ID NO: 248 - protein, 122 aa, Artificial Sequence
  Nanobody sequence
EVQLVESGGGLVQPGGSLRLSCAASGFTFSSYAMSWVRQAPGKGLEWVSGIKSSGDSTRYAGSVKGRFTISRDNAKNTLYLQMNSLRPEDTALYYCAKSRVSRTGLYTYDNRGQGTLVKVSS

SEQ ID NO: 249 - protein, 122 aa, Artificial Sequence
  Nanobody sequence
EVQLVESGGGLVQPGGSLRLSCAASGFTFSSYAMSWVRQAPGKGLEWVSGIKSSGDSTRYAGSVKGRFTISRDNAKNTLYLQMNSLRPEDTALYYCAKSRVSRTGLYTYDNRGQGTLVQVSS

SEQ ID NO: 250 - protein, 122 aa, Artificial Sequence
  Nanobody sequence
EVQLVESGGGLVQPGGSLRLSCAASGFTFSSYAMSWVRQAPGKGLEWVSGIKSSGDSTRYAGSVKGRFTISRDNAKNTLYLQMNSLRPEDTAVYYCAKSRVSRTGLYTYDNRGQGTLVKVSS

SEQ ID NO: 251 - protein, 122 aa, Artificial Sequence
  Nanobody sequence
EVQLVESGGGLVQPGGSLRLSCAASGFTFSSYAMSWVRQAPGKGLEWVSGIKSSGDSTRYAGSVKGRFTISRDNAKNTLYLQMNSLRPEDTAVYYCAKSRVSRTGLYTYDNRGQGTLVQVSS

SEQ ID NO: 252 - protein, 122 aa, Artificial Sequence
  Nanobody sequence
EVQLVESGGGLVQPGGSLRLSCAASGFTFSSYAMSWVRQAPGKGLEWVSGIKSSGDSTRYAGSVKGRFTISRDNAKNTLYLQMNSLRPEDTAVYYCAKSRVSRTGLYTYDNRGQGTLVTVKS

SEQ ID NO: 253 - protein, 122 aa, Artificial Sequence
  Nanobody sequence
EVQLVESGGGLVQPGGSLRLSCAASGFTFSSYAMSWVRQAPGKGLEWVSGIKSSGDSTRYAGSVKGRFTISRDNAKNTLYLQMNSLRPEDTAVYYCAKSRVSRTGLYTYDNRGQGTLVTVQS

SEQ ID NO: 254 - protein, 122 aa, Artificial Sequence
  Nanobody sequence
EVQLVESGGGLVQPGGSLRLSCAASGFTFSSYAMSWVRQAPGKGLEWVSGIKSSGDSTRYAGSVKGRFTISRDNAKNTLYLQMNSLRPEDTATYYCAKSRVSRTGLYTYDNRGQGTLVTVSS

SEQ ID NO: 255 - protein, 122 aa, Artificial Sequence
  Nanobody sequence
EVQLVESGGGVVQPGGSLRLSCAASGFTFSSYAMSWVRQAPGKGLEWVSGIKSSGDSTRYAGSVKGRFTISRDNAKNTLYLQMNSLRPEDTALYYCAKSRVSRTGLYTYDNRGQGTLVTVSS

SEQ ID NO: 256 - protein, 122 aa, Artificial Sequence
  Nanobody sequence
EVQLVESGGGVVQPGGSLRLSCAASGFTFSSYAMSWVRQAPGKGLEWVSGIKSSGDSTRYAGSVKGRFTISRDNAKNTLYLQMNSLRPEDTALYYCAKSRVSRTGLYTYDNRGQGTLVKVSS

SEQ ID NO: 257 - protein, 122 aa, Artificial Sequence
  Nanobody sequence
EVQLVESGGGVVQPGGSLRLSCAASGFTFSSYAMSWVRQAPGKGLEWVSGIKSSGDSTRYAGSVKGRFTISRDNAKNTLYLQMNSLRPEDTALYYCAKSRVSRTGLYTYDNRGQGTLVQVSS

SEQ ID NO: 258 - protein, 122 aa, Artificial Sequence
  Nanobody sequence
EVQLVESGGGVVQPGGSLRLSCAASGFTFSSYAMSWVRQAPGKGLEWVSGIKSSGDSTRYAGSVKGRFTISRDNAKNTLYLQMNSLRPEDTAVYYCAKSRVSRTGLYTYDNRGQGTLVKVSS

SEQ ID NO: 259 - protein, 122 aa, Artificial Sequence
  Nanobody sequence
EVQLVESGGGVVQPGGSLRLSCAASGFTFSSYAMSWVRQAPGKGLEWVSGIKSSGDSTRYAGSVKGRFTISRDNAKNTLYLQMNSLRPEDTAVYYCAKSRVSRTGLYTYDNRGQGTLVQVSS

SEQ ID NO: 260 - protein, 122 aa, Artificial Sequence
  Nanobody sequence
EVQLVESGGGVVQPGGSLRLSCAASGFTFSSYAMSWVRQAPGKGLEWVSGIKSSGDSTRYAGSVKGRFTISRDNAKNTLYLQMNSLRPEDTAVYYCAKSRVSRTGLYTYDNRGQGTLVTVKS

SEQ ID NO: 261 - protein, 122 aa, Artificial Sequence
  Nanobody sequence
EVQLVESGGGVVQPGGSLRLSCAASGFTFSSYAMSWVRQAPGKGLEWVSGIKSSGDSTRYAGSVKGRFTISRDNAKNTLYLQMNSLRPEDTAVYYCAKSRVSRTGLYTYDNRGQGTLVTVQS

SEQ ID NO: 262 - protein, 128 aa, Artificial Sequence; identical to SEQ ID NO: 92
  Nanobody sequence

SEQ ID NO: 263 - protein, 5 aa, Artificial Sequence
  CDR sequence
NYAMG

SEQ ID NO: 264 - protein, 21 aa, Artificial Sequence
  CDR sequence
AITRSGVRSGVSAIYGDSVKD

SEQ ID NO: 265 - protein, 15 aa, Artificial Sequence
  CDR sequence
SAIGSGALRRFEYDY

SEQ ID NO: 266 - protein, 128 aa, Artificial Sequence
  Nanobody sequence
EVQLVESGGGLVQPGGSLRLSCAASGRTFNNYAMGWFRQAPGKEREFVAAITRSGVRSGVSAIYGDSVKDRFTISRDNAKNTLYLQMNSLRPEDTALYYCAASAIGSGALRRFEYDYSGQGTLVKVSS

SEQ ID NO: 267 - protein, 128 aa, Artificial Sequence
  Nanobody sequence
EVQLVESGGGLVQPGGSLRLSCAASGRTFNNYAMGWFRQAPGKEREFVAAITRSGVRSGVSAIYGDSVKDRFTISRDNAKNTLYLQMNSLRPEDTALYYCAASAIGSGALRRFEYDYSGQGTLVQVSS

SEQ ID NO: 268 - protein, 128 aa, Artificial Sequence
  Nanobody sequence
EVQLVESGGGLVQPGGSLRLSCAASGRTFNNYAMGWFRQAPGKEREFVAAITRSGVRSGVSAIYGDSVKDRFTISRDNAKNTLYLQMNSLRPEDTAVYYCAASAIGSGALRRFEYDYSGQGTLVKVSS

SEQ ID NO: 269 - protein, 128 aa, Artificial Sequence
  Nanobody sequence
EVQLVESGGGLVQPGGSLRLSCAASGRTFNNYAMGWFRQAPGKEREFVAAITRSGVRSGVSAIYGDSVKDRFTISRDNAKNTLYLQMNSLRPEDTAVYYCAASAIGSGALRRFEYDYSGQGTLVQVSS

SEQ ID NO: 270 - protein, 128 aa, Artificial Sequence
  Nanobody sequence
EVQLVESGGGLVQPGGSLRLSCAASGRTFNNYAMGWFRQAPGKEREFVAAITRSGVRSGVSAIYGDSVKDRFTISRDNAKNTLYLQMNSLRPEDTAVYYCAASAIGSGALRRFEYDYSGQGTLVTVKS

SEQ ID NO: 271 - protein, 128 aa, Artificial Sequence
  Nanobody sequence
EVQLVESGGGLVQPGGSLRLSCAASGRTFNNYAMGWFRQAPGKEREFVAAITRSGVRSGVSAIYGDSVKDRFTISRDNAKNTLYLQMNSLRPEDTAVYYCAASAIGSGALRRFEYDYSGQGTLVTVQS

SEQ ID NO: 272 - protein, 128 aa, Artificial Sequence
  Nanobody sequence
EVQLVESGGGLVQPGGSLRLSCAASGRTFNNYAMGWFRQAPGKEREFVAAITRSGVRSGVSAIYGDSVKDRFTISRDNAKNTLYLQMNSLRPEDTATYYCAASAIGSGALRRFEYDYSGQGTLVTVSS

SEQ ID NO: 273 - protein, 128 aa, Artificial Sequence
  Nanobody sequence
EVQLVESGGGVVQPGGSLRLSCAASGRTFNNYAMGWFRQAPGKEREFVAAITRSGVRSGVSAIYGDSVKDRFTISRDNAKNTLYLQMNSLRPEDTALYYCAASAIGSGALRRFEYDYSGQGTLVTVSS

SEQ ID NO: 274 - protein, 128 aa, Artificial Sequence
  Nanobody sequence
EVQLVESGGGVVQPGGSLRLSCAASGRTFNNYAMGWFRQAPGKEREFVAAITRSGVRSGVSAIYGDSVKDRFTISRDNAKNTLYLQMNSLRPEDTALYYCAASAIGSGALRRFEYDYSGQGTLVKVSS

SEQ ID NO: 275 - protein, 128 aa, Artificial Sequence
  Nanobody sequence
EVQLVESGGGVVQPGGSLRLSCAASGRTFNNYAMGWFRQAPGKEREFVAAITRSGVRSGVSAIYGDSVKDRFTISRDNAKNTLYLQMNSLRPEDTALYYCAASAIGSGALRRFEYDYSGQGTLVQVSS

SEQ ID NO: 276 - protein, 128 aa, Artificial Sequence
  Nanobody sequence
EVQLVESGGGVVQPGGSLRLSCAASGRTFNNYAMGWFRQAPGKEREFVAAITRSGVRSGVSAIYGDSVKDRFTISRDNAKNTLYLQMNSLRPEDTAVYYCAASAIGSGALRRFEYDYSGQGTLVKVSS

SEQ ID NO: 277 - protein, 128 aa, Artificial Sequence
  Nanobody sequence
EVQLVESGGGVVQPGGSLRLSCAASGRTFNNYAMGWFRQAPGKEREFVAAITRSGVRSGVSAIYGDSVKDRFTISRDNAKNTLYLQMNSLRPEDTAVYYCAASAIGSGALRRFEYDYSGQGTLVQVSS

SEQ ID NO: 278 - protein, 128 aa, Artificial Sequence
  Nanobody sequence
EVQLVESGGGVVQPGGSLRLSCAASGRTFNNYAMGWFRQAPGKEREFVAAITRSGVRSGVSAIYGDSVKDRFTISRDNAKNTLYLQMNSLRPEDTAVYYCAASAIGSGALRRFEYDYSGQGTLVTVKS

SEQ ID NO: 279 - protein, 128 aa, Artificial Sequence
  Nanobody sequence
EVQLVESGGGVVQPGGSLRLSCAASGRTFNNYAMGWFRQAPGKEREFVAAITRSGVRSGVSAIYGDSVKDRFTISRDNAKNTLYLQMNSLRPEDTAVYYCAASAIGSGALRRFEYDYSGQGTLVTVQS

SEQ ID NO: 280 - protein, 118 aa, Artificial Sequence
  Nanobody sequence
DVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSS

SEQ ID NO: 281 - protein, 5 aa, Artificial Sequence
  CDR sequence
LNAMA

SEQ ID NO: 282 - protein, 16 aa, Artificial Sequence
  CDR sequence
GIFGVGSTRYADSVKG

SEQ ID NO: 283 - protein, 10 aa, Artificial Sequence
  CDR sequence
SSVTRGSSDY

SEQ ID NO: 284 - protein, 118 aa, Artificial Sequence
  Nanobody sequence
DVQLVESGGGLVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVKVSS

SEQ ID NO: 285 - protein, 118 aa, Artificial Sequence
  Nanobody sequence
DVQLVESGGGLVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVQVSS

SEQ ID NO: 286 - protein, 118 aa, Artificial Sequence
  Nanobody sequence
DVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVKVSS

SEQ ID NO: 287 - protein, 118 aa, Artificial Sequence
  Nanobody sequence
DVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVQVSS

SEQ ID NO: 288 - protein, 118 aa, Artificial Sequence
  Nanobody sequence
DVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVKS

SEQ ID NO: 289 - protein, 118 aa, Artificial Sequence
  Nanobody sequence
DVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVQS

SEQ ID NO: 290 - protein, 118 aa, Artificial Sequence
  Nanobody sequence
DVQLVESGGGLVQPGGSLRLSCAASGSIGGLNAMAWYRQAPGKERELVAGIFGVGSTRYADSVKGRFTISRDNSKNTVYLQMNSLRPEDTATYYCRMSSVTRGSSDYWGQGTLVTVSS

SEQ ID NO: 291 - protein, 118 aa, Artificial Sequence
  Nanobody sequence
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVTVSS

SEQ ID NO: 292 - protein, 118 aa, Artificial Sequence
  Nanobody sequence
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVKVSS

SEQ ID NO: 293 - protein, 118 aa, Artificial Sequence
  Nanobody sequence
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVQVSS

SEQ ID NO: 294 - protein, 118 aa, Artificial Sequence
  Nanobody sequence
DVQLVESGGGVVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVKVSS

SEQ ID NO: 295 - protein, 118 aa, Artificial Sequence
  Nanobody sequence
DVQLVESGGGVVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVQVSS

SEQ ID NO: 296 - protein, 118 aa, Artificial Sequence
  Nanobody sequence
DVQLVESGGGVVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVKS

SEQ ID NO: 297 - protein, 118 aa, Artificial Sequence
  Nanobody sequence
DVQLVESGGGVVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVQS

SEQ ID NO: 298 - protein, 125 aa, Artificial Sequence
  Nanobody sequence
EVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVSS

SEQ ID NO: 299 - protein, 5 aa, Artificial Sequence
  CDR sequence
LNAMG

SEQ ID NO: 300 - protein, 17 aa, Artificial Sequence
  CDR sequence
AIDWSEGNKDYADSVKG

SEQ ID NO: 301 - protein, 16 aa, Artificial Sequence
  CDR sequence
DTPPWGPLIYIESYDS

SEQ ID NO: 302 - protein, 125 aa, Artificial Sequence
  Nanobody sequence
EVQLVESGGGLVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVKVSS

SEQ ID NO: 303 - protein, 125 aa, Artificial Sequence
  Nanobody sequence
EVQLVESGGGLVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVQVSS

SEQ ID NO: 304 - protein, 125 aa, Artificial Sequence
  Nanobody sequence
EVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVKVSS

SEQ ID NO: 305 - protein, 125 aa, Artificial Sequence
  Nanobody sequence
EVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVQVSS

SEQ ID NO: 306 - protein, 125 aa, Artificial Sequence
  Nanobody sequence
EVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVKS

SEQ ID NO: 307 - protein, 125 aa, Artificial Sequence
  Nanobody sequence
EVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVQS

SEQ ID NO: 308 - protein, 125 aa, Artificial Sequence
  Nanobody sequence
EVQLVESGGGLVQPGGSLRLSCAASGRTYYLNAMGWFRQAPGKEREFVAAIDWSEGNKDYADSVKGRFTISRDNSKNTVYLQMNSLRPEDTATYYCAADTPPWGPLIYIESYDSWGQGTLVTVSS

SEQ ID NO: 309 - protein, 125 aa, Artificial Sequence
  Nanobody sequence
EVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVTVSS

SEQ ID NO: 310 - protein, 125 aa, Artificial Sequence
  Nanobody sequence
EVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVKVSS

SEQ ID NO: 311 - protein, 125 aa, Artificial Sequence
  Nanobody sequence
EVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVQVSS

SEQ ID NO: 312 - protein, 125 aa, Artificial Sequence
  Nanobody sequence
EVQLVESGGGVVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVKVSS

SEQ ID NO: 313 - protein, 125 aa, Artificial Sequence
  Nanobody sequence
EVQLVESGGGVVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVQVSS

SEQ ID NO: 314 - protein, 125 aa, Artificial Sequence
  Nanobody sequence
EVQLVESGGGVVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVKS

SEQ ID NO: 315 - protein, 125 aa, Artificial Sequence
  Nanobody sequence
EVQLVESGGGVVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVQS

SEQ ID NO: 316 - protein, 115 aa, Artificial Sequence
  Nanobody sequence
EVQLVESGGGLVQPGGSLRLSCAASGFTFSDYWMYWVRQAPGKGLEWVSEINTNGLITKYPDSVKGRFTISRDNAKNTLYLQMNSLRPEDTAVYYCARSPSGFNRGQGTLVTVSS

SEQ ID NO: 317 - protein, 5 aa, Artificial Sequence
  CDR sequence
DYWMY

SEQ ID NO: 318 - protein, 17 aa, Artificial Sequence
  CDR sequence
EINTNGLITKYPDSVKG

SEQ ID NO: 319 - protein, 6 aa, Artificial Sequence
  CDR sequence
SPSGFN

SEQ ID NO: 320 - protein, 115 aa, Artificial Sequence
  Nanobody sequence
EVQLVESGGGLVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSS

SEQ ID NO: 321 - protein, 115 aa, Artificial Sequence
  Nanobody sequence
EVQLVESGGGLVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSS

SEQ ID NO: 322 - protein, 115 aa, Artificial Sequence
  Nanobody sequence
EVQLVESGGGLVQPGGSLRLSCAASGFTFSDYWMYWVRQAPGKGLEWVSEINTNGLITKYPDSVKGRFTISRDNAKNTLYLQMNSLRPEDTAVYYCARSPSGFNRGQGTLVKVSS

SEQ ID NO: 323 - protein, 115 aa, Artificial Sequence
  Nanobody sequence
EVQLVESGGGLVQPGGSLRLSCAASGFTFSDYWMYWVRQAPGKGLEWVSEINTNGLITKYPDSVKGRFTISRDNAKNTLYLQMNSLRPEDTAVYYCARSPSGFNRGQGTLVQVSS

SEQ ID NO: 324 - protein, 115 aa, Artificial Sequence
  Nanobody sequence
EVQLVESGGGLVQPGGSLRLSCAASGFTFSDYWMYWVRQAPGKGLEWVSEINTNGLITKYPDSVKGRFTISRDNAKNTLYLQMNSLRPEDTAVYYCARSPSGFNRGQGTLVTVKS

SEQ ID NO: 325 - protein, 115 aa, Artificial Sequence
  Nanobody sequence
EVQLVESGGGLVQPGGSLRLSCAASGFTFSDYWMYWVRQAPGKGLEWVSEINTNGLITKYPDSVKGRFTISRDNAKNTLYLQMNSLRPEDTAVYYCARSPSGFNRGQGTLVTVQS

SEQ ID NO: 326 - protein, 115 aa, Artificial Sequence
  Nanobody sequence
EVQLVESGGGLVQPGGSLRLSCAASGFTFSDYWMYWVRQAPGKGLEWVSEINTNGLITKYPDSVKGRFTISRDNAKNTLYLQMNSLRPEDTATYYCARSPSGFNRGQGTLVTVSS

SEQ ID NO: 327 - protein, 115 aa, Artificial Sequence
  Nanobody sequence
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSS

SEQ ID NO: 328 - protein, 115 aa, Artificial Sequence
  Nanobody sequence
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSS

SEQ ID NO: 329 - protein, 115 aa, Artificial Sequence
  Nanobody sequence
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSS

SEQ ID NO: 330 - protein, 115 aa, Artificial Sequence
  Nanobody sequence
EVQLVESGGGVVQPGGSLRLSCAASGFTFSDYWMYWVRQAPGKGLEWVSEINTNGLITKYPDSVKGRFTISRDNAKNTLYLQMNSLRPEDTAVYYCARSPSGFNRGQGTLVKVSS

SEQ ID NO: 331 - protein, 115 aa, Artificial Sequence
  Nanobody sequence
EVQLVESGGGVVQPGGSLRLSCAASGFTFSDYWMYWVRQAPGKGLEWVSEINTNGLITKYPDSVKGRFTISRDNAKNTLYLQMNSLRPEDTAVYYCARSPSGFNRGQGTLVQVSS

SEQ ID NO: 332 - protein, 115 aa, Artificial Sequence
  Nanobody sequence
EVQLVESGGGVVQPGGSLRLSCAASGFTFSDYWMYWVRQAPGKGLEWVSEINTNGLITKYPDSVKGRFTISRDNAKNTLYLQMNSLRPEDTAVYYCARSPSGFNRGQGTLVTVKS

SEQ ID NO: 333 - protein, 115 aa, Artificial Sequence
  Nanobody sequence
EVQLVESGGGVVQPGGSLRLSCAASGFTFSDYWMYWVRQAPGKGLEWVSEINTNGLITKYPDSVKGRFTISRDNAKNTLYLQMNSLRPEDTAVYYCARSPSGFNRGQGTLVTVQS

SEQ ID NO: 334 - protein, 121 aa, Artificial Sequence
  Nanobody sequence
EVQLVESGGGLVQPGGSLRLSCTASGFTFSTADMGWFRQAPGKGREFVSRISGIDGTTYYDEPVKGRFTISRDNAKNTLYLQMNSLRPEDTAVYYCRSPRYADQWSAYDYWGQGTLVTVSS

SEQ ID NO: 335 - protein, 5 aa, Artificial Sequence
  CDR sequence
TADMG

SEQ ID NO: 336 - protein, 17 aa, Artificial Sequence
  CDR sequence
RISGIDGTTYYDEPVKG

SEQ ID NO: 337 - protein, 12 aa, Artificial Sequence
  CDR sequence
PRYADQWSAYDY

SEQ ID NO: 338 - protein, 121 aa, Artificial Sequence
  Nanobody sequence
EVQLVESGGGLVQPGGSLRLSCTASGFTFSTADMGWFRQAPGKGREFVSRISGIDGTTYYDEPVKGRFTISRDNAKNTLYLQMNSLRPEDTALYYCRSPRYADQWSAYDYWGQGTLVKVSS

SEQ ID NO: 339 - protein, 121 aa, Artificial Sequence
  Nanobody sequence
EVQLVESGGGLVQPGGSLRLSCTASGFTFSTADMGWFRQAPGKGREFVSRISGIDGTTYYDEPVKGRFTISRDNAKNTLYLQMNSLRPEDTALYYCRSPRYADQWSAYDYWGQGTLVQVSS

SEQ ID NO: 340 - protein, 121 aa, Artificial Sequence
  Nanobody sequence
EVQLVESGGGLVQPGGSLRLSCTASGFTFSTADMGWFRQAPGKGREFVSRISGIDGTTYYDEPVKGRFTISRDNAKNTLYLQMNSLRPEDTAVYYCRSPRYADQWSAYDYWGQGTLVKVSS

SEQ ID NO: 341 - protein, 121 aa, Artificial Sequence
  Nanobody sequence
EVQLVESGGGLVQPGGSLRLSCTASGFTFSTADMGWFRQAPGKGREFVSRISGIDGTTYYDEPVKGRFTISRDNAKNTLYLQMNSLRPEDTAVYYCRSPRYADQWSAYDYWGQGTLVQVSS

SEQ ID NO: 342 - protein, 121 aa, Artificial Sequence
  Nanobody sequence
EVQLVESGGGLVQPGGSLRLSCTASGFTFSTADMGWFRQAPGKGREFVSRISGIDGTTYYDEPVKGRFTISRDNAKNTLYLQMNSLRPEDTAVYYCRSPRYADQWSAYDYWGQGTLVTVKS

SEQ ID NO: 343 - protein, 121 aa, Artificial Sequence
  Nanobody sequence
EVQLVESGGGLVQPGGSLRLSCTASGFTFSTADMGWFRQAPGKGREFVSRISGIDGTTYYDEPVKGRFTISRDNAKNTLYLQMNSLRPEDTAVYYCRSPRYADQWSAYDYWGQGTLVTVQS

SEQ ID NO: 344 - protein, 121 aa, Artificial Sequence
  Nanobody sequence
EVQLVESGGGLVQPGGSLRLSCTASGFTFSTADMGWFRQAPGKGREFVSRISGIDGTTYYDEPVKGRFTISRDNAKNTLYLQMNSLRPEDTATYYCRSPRYADQWSAYDYWGQGTLVTVSS

SEQ ID NO: 345 - protein, 121 aa, Artificial Sequence
  Nanobody sequence
EVQLVESGGGVVQPGGSLRLSCTASGFTFSTADMGWFRQAPGKGREFVSRISGIDGTTYYDEPVKGRFTISRDNAKNTLYLQMNSLRPEDTALYYCRSPRYADQWSAYDYWGQGTLVTVSS

SEQ ID NO: 346 - protein, 121 aa, Artificial Sequence
  Nanobody sequence
EVQLVESGGGVVQPGGSLRLSCTASGFTFSTADMGWFRQAPGKGREFVSRISGIDGTTYYDEPVKGRFTISRDNAKNTLYLQMNSLRPEDTALYYCRSPRYADQWSAYDYWGQGTLVKVSS

SEQ ID NO: 347 - protein, 121 aa, Artificial Sequence
  Nanobody sequence
EVQLVESGGGVVQPGGSLRLSCTASGFTFSTADMGWFRQAPGKGREFVSRISGIDGTTYYDEPVKGRFTISRDNAKNTLYLQMNSLRPEDTALYYCRSPRYADQWSAYDYWGQGTLVQVSS

SEQ ID NO: 348 - protein, 121 aa, Artificial Sequence
  Nanobody sequence
EVQLVESGGGVVQPGGSLRLSCTASGFTFSTADMGWFRQAPGKGREFVSRISGIDGTTYYDEPVKGRFTISRDNAKNTLYLQMNSLRPEDTAVYYCRSPRYADQWSAYDYWGQGTLVKVSS

SEQ ID NO: 349 - protein, 121 aa, Artificial Sequence
  Nanobody sequence
EVQLVESGGGVVQPGGSLRLSCTASGFTFSTADMGWFRQAPGKGREFVSRISGIDGTTYYDEPVKGRFTISRDNAKNTLYLQMNSLRPEDTAVYYCRSPRYADQWSAYDYWGQGTLVQVSS

SEQ ID NO: 350 - protein, 121 aa, Artificial Sequence
  Nanobody sequence
EVQLVESGGGVVQPGGSLRLSCTASGFTFSTADMGWFRQAPGKGREFVSRISGIDGTTYYDEPVKGRFTISRDNAKNTLYLQMNSLRPEDTAVYYCRSPRYADQWSAYDYWGQGTLVTVKS

SEQ ID NO: 351 - protein, 121 aa, Artificial Sequence
  Nanobody sequence
EVQLVESGGGVVQPGGSLRLSCTASGFTFSTADMGWFRQAPGKGREFVSRISGIDGTTYYDEPVKGRFTISRDNAKNTLYLQMNSLRPEDTAVYYCRSPRYADQWSAYDYWGQGTLVTVQS

SEQ ID NO: 352 - protein, 125 aa, Artificial Sequence
  Nanobody sequence
DVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSS

SEQ ID NO: 353 - protein, 5 aa, Artificial Sequence
  CDR sequence
YYAIG

SEQ ID NO: 354 - protein, 17 aa, Artificial Sequence
  CDR sequence
CIDASDDITYYADSVKG

SEQ ID NO: 355 - protein, 16 aa, Artificial Sequence
  CDR sequence
PIGLSSSCLLEYDYDY

SEQ ID NO: 356 - protein, 125 aa, Artificial Sequence
  Nanobody sequence
DVQLVESGGGLVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVKVSS

SEQ ID NO: 357 - protein, 125 aa, Artificial Sequence
  Nanobody sequence
DVQLVESGGGLVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVQVSS

SEQ ID NO: 358 - protein, 125 aa, Artificial Sequence
  Nanobody sequence
DVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVKVSS

SEQ ID NO: 359 - protein, 125 aa, Artificial Sequence
  Nanobody sequence
DVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVQVSS

SEQ ID NO: 360 - protein, 125 aa, Artificial Sequence
  Nanobody sequence
DVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVKS

SEQ ID NO: 361 - protein, 125 aa, Artificial Sequence
  Nanobody sequence
DVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVQS

SEQ ID NO: 362 - protein, 125 aa, Artificial Sequence
  Nanobody sequence
DVQLVESGGGLVQPGGSLRLSCAASGFILDYYAIGWFRQAPGKEREGVLCIDASDDITYYADSVKGRFTISRDNSKNTVYLQMNSLRPEDTATYYCATPIGLSSSCLLEYDYDYWGQGTLVTVSS

SEQ ID NO: 363 - protein, 125 aa, Artificial Sequence
  Nanobody sequence
DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVTVSS

SEQ ID NO: 364 - protein, 125 aa, Artificial Sequence
  Nanobody sequence
DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVKVSS

SEQ ID NO: 365 - protein, 125 aa, Artificial Sequence
  Nanobody sequence
DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVQVSS

SEQ ID NO: 366 - protein, 125 aa, Artificial Sequence
  Nanobody sequence
DVQLVESGGGVVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVKVSS

SEQ ID NO: 367 - protein, 125 aa, Artificial Sequence
  Nanobody sequence
DVQLVESGGGVVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVQVSS

SEQ ID NO: 368 - protein, 125 aa, Artificial Sequence
  Nanobody sequence
DVQLVESGGGVVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVKS

SEQ ID NO: 369 - protein, 125 aa, Artificial Sequence
  Nanobody sequence
DVQLVESGGGVVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVQS

SEQ ID NO: 370 - protein, 124 aa, Artificial Sequence
  Nanobody sequence
DVQLVESGGGLVQPGGSLRLSCAASGFAFDDYAIGWFRQAPGEEREGVSSISSTYGLTYYADSVKGRFTISSDNSKNTVYLQMNSLRPEDTAVYYCAATPIGLIGLDAYEYDYWGQGTLVTVSS

SEQ ID NO: 371 - protein, 6 aa, Artificial Sequence
  CDR sequence
DDYAIG

SEQ ID NO: 372 - protein, 17 aa, Artificial Sequence
  CDR sequence
SISSTYGLTYYADSVKG

SEQ ID NO: 373 - protein, 15 aa, Artificial Sequence
  CDR sequence
TPIGLIGLDAYEYDY

SEQ ID NO: 374 - protein, 124 aa, Artificial Sequence
  Nanobody sequence
DVQLVESGGGLVQPGGSLRLSCAASGFAFDDYAIGWFRQAPGEEREGVSSISSTYGLTYYADSVKGRFTISSDNSKNTVYLQMNSLRPEDTALYYCAATPIGLIGLDAYEYDYWGQGTLVKVSS

SEQ ID NO: 375 - protein, 124 aa, Artificial Sequence
  Nanobody sequence
DVQLVESGGGLVQPGGSLRLSCAASGFAFDDYAIGWFRQAPGEEREGVSSISSTYGLTYYADSVKGRFTISSDNSKNTVYLQMNSLRPEDTALYYCAATPIGLIGLDAYEYDYWGQGTLVQVSS

SEQ ID NO: 376 - protein, 124 aa, Artificial Sequence
  Nanobody sequence
DVQLVESGGGLVQPGGSLRLSCAASGFAFDDYAIGWFRQAPGEEREGVSSISSTYGLTYYADSVKGRFTISSDNSKNTVYLQMNSLRPEDTAVYYCAATPIGLIGLDAYEYDYWGQGTLVKVSS

SEQ ID NO: 377 - protein, 124 aa, Artificial Sequence
  Nanobody sequence
DVQLVESGGGLVQPGGSLRLSCAASGFAFDDYAIGWFRQAPGEEREGVSSISSTYGLTYYADSVKGRFTISSDNSKNTVYLQMNSLRPEDTAVYYCAATPIGLIGLDAYEYDYWGQGTLVQVSS

SEQ ID NO: 378 - protein, 124 aa, Artificial Sequence
  Nanobody sequence
DVQLVESGGGLVQPGGSLRLSCAASGFAFDDYAIGWFRQAPGEEREGVSSISSTYGLTYYADSVKGRFTISSDNSKNTVYLQMNSLRPEDTAVYYCAATPIGLIGLDAYEYDYWGQGTLVTVKS

SEQ ID NO: 379 - protein, 124 aa, Artificial Sequence
  Nanobody sequence
DVQLVESGGGLVQPGGSLRLSCAASGFAFDDYAIGWFRQAPGEEREGVSSISSTYGLTYYADSVKGRFTISSDNSKNTVYLQMNSLRPEDTAVYYCAATPIGLIGLDAYEYDYWGQGTLVTVQS

SEQ ID NO: 380 - protein, 124 aa, Artificial Sequence
  Nanobody sequence
DVQLVESGGGLVQPGGSLRLSCAASGFAFDDYAIGWFRQAPGEEREGVSSISSTYGLTYYADSVKGRFTISSDNSKNTVYLQMNSLRPEDTATYYCAATPIGLIGLDAYEYDYWGQGTLVTVSS

SEQ ID NO: 381 - protein, 124 aa, Artificial Sequence
  Nanobody sequence
DVQLVESGGGVVQPGGSLRLSCAASGFAFDDYAIGWFRQAPGEEREGVSSISSTYGLTYYADSVKGRFTISSDNSKNTVYLQMNSLRPEDTALYYCAATPIGLIGLDAYEYDYWGQGTLVTVSS

SEQ ID NO: 382 - protein, 124 aa, Artificial Sequence
  Nanobody sequence
DVQLVESGGGVVQPGGSLRLSCAASGFAFDDYAIGWFRQAPGEEREGVSSISSTYGLTYYADSVKGRFTISSDNSKNTVYLQMNSLRPEDTALYYCAATPIGLIGLDAYEYDYWGQGTLVKVSS

SEQ ID NO: 383 - protein, 124 aa, Artificial Sequence
  Nanobody sequence
DVQLVESGGGVVQPGGSLRLSCAASGFAFDDYAIGWFRQAPGEEREGVSSISSTYGLTYYADSVKGRFTISSDNSKNTVYLQMNSLRPEDTALYYCAATPIGLIGLDAYEYDYWGQGTLVQVSS

SEQ ID NO: 384 - protein, 124 aa, Artificial Sequence
  Nanobody sequence
DVQLVESGGGVVQPGGSLRLSCAASGFAFDDYAIGWFRQAPGEEREGVSSISSTYGLTYYADSVKGRFTISSDNSKNTVYLQMNSLRPEDTAVYYCAATPIGLIGLDAYEYDYWGQGTLVKVSS

SEQ ID NO: 385 - protein, 124 aa, Artificial Sequence
  Nanobody sequence
DVQLVESGGGVVQPGGSLRLSCAASGFAFDDYAIGWFRQAPGEEREGVSSISSTYGLTYYADSVKGRFTISSDNSKNTVYLQMNSLRPEDTAVYYCAATPIGLIGLDAYEYDYWGQGTLVQVSS

SEQ ID NO: 386 - protein, 124 aa, Artificial Sequence
  Nanobody sequence
DVQLVESGGGVVQPGGSLRLSCAASGFAFDDYAIGWFRQAPGEEREGVSSISSTYGLTYYADSVKGRFTISSDNSKNTVYLQMNSLRPEDTAVYYCAATPIGLIGLDAYEYDYWGQGTLVTVKS

SEQ ID NO: 387 - protein, 124 aa, Artificial Sequence
  Nanobody sequence
DVQLVESGGGVVQPGGSLRLSCAASGFAFDDYAIGWFRQAPGEEREGVSSISSTYGLTYYADSVKGRFTISSDNSKNTVYLQMNSLRPEDTAVYYCAATPIGLIGLDAYEYDYWGQGTLVTVQS

SEQ ID NO: 388 - protein, 126 aa, Artificial Sequence
  Nanobody sequence
EVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVSS

SEQ ID NO: 389 - protein, 5 aa, Artificial Sequence
  CDR sequence
SYPMG

SEQ ID NO: 390 - protein, 17 aa, Artificial Sequence
  CDR sequence
SITGSGGSTYYADSVKG

SEQ ID NO: 391 - protein, 17 aa, Artificial Sequence
  CDR sequence
YIRPDTYLSRDYRKYDY

SEQ ID NO: 392 - protein, 126 aa, Artificial Sequence
  Nanobody sequence
EVQLVESGGGLVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVKVSS

SEQ ID NO: 393 - protein, 126 aa, Artificial Sequence
  Nanobody sequence
EVQLVESGGGLVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVQVSS

SEQ ID NO: 394 - protein, 126 aa, Artificial Sequence
  Nanobody sequence
EVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVKVSS

SEQ ID NO: 395 - protein, 126 aa, Artificial Sequence
  Nanobody sequence
EVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVQVSS

SEQ ID NO: 396 - protein, 126 aa, Artificial Sequence
  Nanobody sequence
EVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVKS

SEQ ID NO: 397 - protein, 126 aa, Artificial Sequence
  Nanobody sequence
EVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVQS

SEQ ID NO: 398 - protein, 126 aa, Artificial Sequence
  Nanobody sequence
EVQLVESGGGLVQPGGSLRLSCAASGFTFSSYPMGWFRQAPGKGREFVSSITGSGGSTYYADSVKGRFTISRDNAKNTLYLQMNSLRPEDTATYYCAAYIRPDTYLSRDYRKYDYWGQGTLVTVSS

SEQ ID NO: 399 - protein, 126 aa, Artificial Sequence
  Nanobody sequence
EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSS

SEQ ID NO: 400 - protein, 126 aa, Artificial Sequence
  Nanobody sequence
EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVKVSS

SEQ ID NO: 401 - protein, 126 aa, Artificial Sequence
  Nanobody sequence
EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVQVSS

SEQ ID NO: 402 - protein, 126 aa, Artificial Sequence
  Nanobody sequence
EVQLVESGGGVVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVKVSS

SEQ ID NO: 403 - protein, 126 aa, Artificial Sequence
  Nanobody sequence
EVQLVESGGGVVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVQVSS

SEQ ID NO: 404 - protein, 126 aa, Artificial Sequence
  Nanobody sequence
EVQLVESGGGVVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVKS

SEQ ID NO: 405 - protein, 126 aa, Artificial Sequence
  Nanobody sequence
EVQLVESGGGVVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVQS

SEQ ID NO: 406 - protein, 120 aa, Artificial Sequence
  Nanobody sequence
EVQLVESGGGLVQPGGSLRISCAASGSIYLINYMGWYRQAPGKQRELVATLTSGGSTNYAGSVKGRFAISRDNAKNTVYLQMNSLKPEDTAVYYCNIGGTLYDRRRFESWGQGTLVTVSS

SEQ ID NO: 407 - protein, 5 aa, Artificial Sequence
  CDR sequence
INYMG

SEQ ID NO: 408 - protein, 16 aa, Artificial Sequence
  CDR sequence
TLTSGGSTNYAGSVKG

SEQ ID NO: 409 - protein, 12 aa, Artificial Sequence
  CDR sequence
GGTLYDRRRFES

SEQ ID NO: 410 - protein, 120 aa, Artificial Sequence
  Nanobody sequence
EVQLVESGGGLVQPGGSLRISCAASGSIYLINYMGWYRQAPGKQRELVATLTSGGSTNYAGSVKGRFAISRDNAKNTVYLQMNSLKPEDTALYYCNIGGTLYDRRRFESWGQGTLVKVSS

SEQ ID NO: 411 - protein, 120 aa, Artificial Sequence
  Nanobody sequence
EVQLVESGGGLVQPGGSLRISCAASGSIYLINYMGWYRQAPGKQRELVATLTSGGSTNYAGSVKGRFAISRDNAKNTVYLQMNSLKPEDTALYYCNIGGTLYDRRRFESWGQGTLVQVSS

SEQ ID NO: 412 - protein, 120 aa, Artificial Sequence
  Nanobody sequence
EVQLVESGGGLVQPGGSLRISCAASGSIYLINYMGWYRQAPGKQRELVATLTSGGSTNYAGSVKGRFAISRDNAKNTVYLQMNSLKPEDTAVYYCNIGGTLYDRRRFESWGQGTLVKVSS

SEQ ID NO: 413 - protein, 120 aa, Artificial Sequence
  Nanobody sequence
EVQLVESGGGLVQPGGSLRISCAASGSIYLINYMGWYRQAPGKQRELVATLTSGGSTNYAGSVKGRFAISRDNAKNTVYLQMNSLKPEDTAVYYCNIGGTLYDRRRFESWGQGTLVQVSS

SEQ ID NO: 414 - protein, 120 aa, Artificial Sequence
  Nanobody sequence
EVQLVESGGGLVQPGGSLRISCAASGSIYLINYMGWYRQAPGKQRELVATLTSGGSTNYAGSVKGRFAISRDNAKNTVYLQMNSLKPEDTAVYYCNIGGTLYDRRRFESWGQGTLVTVKS

SEQ ID NO: 415 - protein, 120 aa, Artificial Sequence
  Nanobody sequence
EVQLVESGGGLVQPGGSLRISCAASGSIYLINYMGWYRQAPGKQRELVATLTSGGSTNYAGSVKGRFAISRDNAKNTVYLQMNSLKPEDTAVYYCNIGGTLYDRRRFESWGQGTLVTVQS

SEQ ID NO: 416 - protein, 120 aa, Artificial Sequence
  Nanobody sequence
EVQLVESGGGLVQPGGSLRISCAASGSIYLINYMGWYRQAPGKQRELVATLTSGGSTNYAGSVKGRFAISRDNAKNTVYLQMNSLKPEDTATYYCNIGGTLYDRRRFESWGQGTLVTVSS

SEQ ID NO: 417 - protein, 120 aa, Artificial Sequence
  Nanobody sequence
EVQLVESGGGVVQPGGSLRISCAASGSIYLINYMGWYRQAPGKQRELVATLTSGGSTNYAGSVKGRFAISRDNAKNTVYLQMNSLKPEDTALYYCNIGGTLYDRRRFESWGQGTLVTVSS

SEQ ID NO: 418 - protein, 120 aa, Artificial Sequence
  Nanobody sequence
EVQLVESGGGVVQPGGSLRISCAASGSIYLINYMGWYRQAPGKQRELVATLTSGGSTNYAGSVKGRFAISRDNAKNTVYLQMNSLKPEDTALYYCNIGGTLYDRRRFESWGQGTLVKVSS

SEQ ID NO: 419 - protein, 120 aa, Artificial Sequence
  Nanobody sequence
EVQLVESGGGVVQPGGSLRISCAASGSIYLINYMGWYRQAPGKQRELVATLTSGGSTNYAGSVKGRFAISRDNAKNTVYLQMNSLKPEDTALYYCNIGGTLYDRRRFESWGQGTLVQVSS

SEQ ID NO: 420 - protein, 120 aa, Artificial Sequence
  Nanobody sequence
EVQLVESGGGVVQPGGSLRISCAASGSIYLINYMGWYRQAPGKQRELVATLTSGGSTNYAGSVKGRFAISRDNAKNTVYLQMNSLKPEDTAVYYCNIGGTLYDRRRFESWGQGTLVKVSS

SEQ ID NO: 421 - protein, 120 aa, Artificial Sequence
  Nanobody sequence
EVQLVESGGGVVQPGGSLRISCAASGSIYLINYMGWYRQAPGKQRELVATLTSGGSTNYAGSVKGRFAISRDNAKNTVYLQMNSLKPEDTAVYYCNIGGTLYDRRRFESWGQGTLVQVSS

SEQ ID NO: 422 - protein, 120 aa, Artificial Sequence
  Nanobody sequence
EVQLVESGGGVVQPGGSLRISCAASGSIYLINYMGWYRQAPGKQRELVATLTSGGSTNYAGSVKGRFAISRDNAKNTVYLQMNSLKPEDTAVYYCNIGGTLYDRRRFESWGQGTLVTVKS

SEQ ID NO: 423 - protein, 120 aa, Artificial Sequence; identical to SEQ ID NO: 421
  Nanobody sequence

SEQ ID NO: 424 - protein, 126 aa, Artificial Sequence
  Nanobody sequence
EVQLVESGGGLVQTGASLRLSCAASGRTFSNYAMGWFRQAPGKERERVAAITPRAFTTYYADSVKGRFTISRDNAKNTAYLQMVSLKPEDTAVYYCAAQLVGSGSNLGRQESYAYWGQGTLVTVSS

SEQ ID NO: 425 - protein, 5 aa, Artificial Sequence
  CDR sequence
NYAMG

SEQ ID NO: 426 - protein, 17 aa, Artificial Sequence
  CDR sequence
AITPRAFTTYYADSVKG

SEQ ID NO: 427 - protein, 17 aa, Artificial Sequence
  CDR sequence
QLVGSGSNLGRQESYAY

SEQ ID NO: 428 - protein, 126 aa, Artificial Sequence
  Nanobody sequence
EVQLVESGGGLVQTGASLRLSCAASGRTFSNYAMGWFRQAPGKERERVAAITPRAFTTYYADSVKGRFTISRDNAKNTAYLQMVSLKPEDTALYYCAAQLVGSGSNLGRQESYAYWGQGTLVKVSS

SEQ ID NO: 429 - protein, 126 aa, Artificial Sequence
  Nanobody sequence
EVQLVESGGGLVQTGASLRLSCAASGRTFSNYAMGWFRQAPGKERERVAAITPRAFTTYYADSVKGRFTISRDNAKNTAYLQMVSLKPEDTALYYCAAQLVGSGSNLGRQESYAYWGQGTLVQVSS

SEQ ID NO: 430 - protein, 126 aa, Artificial Sequence
  Nanobody sequence
EVQLVESGGGLVQTGASLRLSCAASGRTFSNYAMGWFRQAPGKERERVAAITPRAFTTYYADSVKGRFTISRDNAKNTAYLQMVSLKPEDTAVYYCAAQLVGSGSNLGRQESYAYWGQGTLVKVSS

SEQ ID NO: 431 - protein, 126 aa, Artificial Sequence
  Nanobody sequence
EVQLVESGGGLVQTGASLRLSCAASGRTFSNYAMGWFRQAPGKERERVAAITPRAFTTYYADSVKGRFTISRDNAKNTAYLQMVSLKPEDTAVYYCAAQLVGSGSNLGRQESYAYWGQGTLVQVSS

SEQ ID NO: 432 - protein, 126 aa, Artificial Sequence
  Nanobody sequence
EVQLVESGGGLVQTGASLRLSCAASGRTFSNYAMGWFRQAPGKERERVAAITPRAFTTYYADSVKGRFTISRDNAKNTAYLQMVSLKPEDTAVYYCAAQLVGSGSNLGRQESYAYWGQGTLVTVKS

SEQ ID NO: 433 - protein, 126 aa, Artificial Sequence
  Nanobody sequence
EVQLVESGGGLVQTGASLRLSCAASGRTFSNYAMGWFRQAPGKERERVAAITPRAFTTYYADSVKGRFTISRDNAKNTAYLQMVSLKPEDTAVYYCAAQLVGSGSNLGRQESYAYWGQGTLVTVQS

SEQ ID NO: 434 - protein, 126 aa, Artificial Sequence
  Nanobody sequence
EVQLVESGGGLVQTGASLRLSCAASGRTFSNYAMGWFRQAPGKERERVAAITPRAFTTYYADSVKGRFTISRDNAKNTAYLQMVSLKPEDTATYYCAAQLVGSGSNLGRQESYAYWGQGTLVTVSS

SEQ ID NO: 435 - protein, 126 aa, Artificial Sequence
  Nanobody sequence
EVQLVESGGGVVQTGASLRLSCAASGRTFSNYAMGWFRQAPGKERERVAAITPRAFTTYYADSVKGRFTISRDNAKNTAYLQMVSLKPEDTALYYCAAQLVGSGSNLGRQESYAYWGQGTLVTVSS

SEQ ID NO: 436 - protein, 126 aa, Artificial Sequence
  Nanobody sequence
EVQLVESGGGVVQTGASLRLSCAASGRTFSNYAMGWFRQAPGKERERVAAITPRAFTTYYADSVKGRFTISRDNAKNTAYLQMVSLKPEDTALYYCAAQLVGSGSNLGRQESYAYWGQGTLVKVSS

SEQ ID NO: 437 - protein, 126 aa, Artificial Sequence
  Nanobody sequence
EVQLVESGGGVVQTGASLRLSCAASGRTFSNYAMGWFRQAPGKERERVAAITPRAFTTYYADSVKGRFTISRDNAKNTAYLQMVSLKPEDTALYYCAAQLVGSGSNLGRQESYAYWGQGTLVQVSS

SEQ ID NO: 438 - protein, 126 aa, Artificial Sequence
  Nanobody sequence
EVQLVESGGGVVQTGASLRLSCAASGRTFSNYAMGWFRQAPGKERERVAAITPRAFTTYYADSVKGRFTISRDNAKNTAYLQMVSLKPEDTAVYYCAAQLVGSGSNLGRQESYAYWGQGTLVKVSS

SEQ ID NO: 439 - protein, 126 aa, Artificial Sequence
  Nanobody sequence
EVQLVESGGGVVQTGASLRLSCAASGRTFSNYAMGWFRQAPGKERERVAAITPRAFTTYYADSVKGRFTISRDNAKNTAYLQMVSLKPEDTAVYYCAAQLVGSGSNLGRQESYAYWGQGTLVQVSS

SEQ ID NO: 440 - protein, 126 aa, Artificial Sequence
  Nanobody sequence
EVQLVESGGGVVQTGASLRLSCAASGRTFSNYAMGWFRQAPGKERERVAAITPRAFTTYYADSVKGRFTISRDNAKNTAYLQMVSLKPEDTAVYYCAAQLVGSGSNLGRQESYAYWGQGTLVTVKS

SEQ ID NO: 441 - protein, 126 aa, Artificial Sequence
  Nanobody sequence
EVQLVESGGGVVQTGASLRLSCAASGRTFSNYAMGWFRQAPGKERERVAAITPRAFTTYYADSVKGRFTISRDNAKNTAYLQMVSLKPEDTAVYYCAAQLVGSGSNLGRQESYAYWGQGTLVTVQS

SEQ ID NO: 442 - protein, 117 aa, Artificial Sequence
  Nanobody sequence
EVQLVESGGGLVQAGESLTLSCAASGRTLSAYIMGWFRQAPGKEREFVAGIWSGGYTHLADSAKGRFSISRDNAKNTVYLQMNGLKPEDTAVYYCAAGLRGRQYSNWGQGTLVTVSS

SEQ ID NO: 443 - protein, 5 aa, Artificial Sequence
  CDR sequence
AYIMG

SEQ ID NO: 444 - protein, 16 aa, Artificial Sequence
  CDR sequence
GIWSGGYTHLADSAKG

SEQ ID NO: 445 - protein, 16 aa, Artificial Sequence
  CDR sequence
GIWSGGYTHLADSAKG

SEQ ID NO: 446 - protein, 117 aa, Artificial Sequence
  Nanobody sequence
EVQLVESGGGLVQAGESLTLSCAASGRTLSAYIMGWFRQAPGKEREFVAGIWSGGYTHLADSAKGRFSISRDNAKNTVYLQMNGLKPEDTALYYCAAGLRGRQYSNWGQGTLVKVSS

SEQ ID NO: 447 - protein, 117 aa, Artificial Sequence
  Nanobody sequence
EVQLVESGGGLVQAGESLTLSCAASGRTLSAYIMGWFRQAPGKEREFVAGIWSGGYTHLADSAKGRFSISRDNAKNTVYLQMNGLKPEDTALYYCAAGLRGRQYSNWGQGTLVQVSS

SEQ ID NO: 448 - protein, 117 aa, Artificial Sequence
  Nanobody sequence
EVQLVESGGGLVQAGESLTLSCAASGRTLSAYIMGWFRQAPGKEREFVAGIWSGGYTHLADSAKGRFSISRDNAKNTVYLQMNGLKPEDTAVYYCAAGLRGRQYSNWGQGTLVKVSS

SEQ ID NO: 449 - protein, 117 aa, Artificial Sequence
  Nanobody sequence
EVQLVESGGGLVQAGESLTLSCAASGRTLSAYIMGWFRQAPGKEREFVAGIWSGGYTHLADSAKGRFSISRDNAKNTVYLQMNGLKPEDTAVYYCAAGLRGRQYSNWGQGTLVQVSS

SEQ ID NO: 450 - protein, 117 aa, Artificial Sequence
  Nanobody sequence
EVQLVESGGGLVQAGESLTLSCAASGRTLSAYIMGWFRQAPGKEREFVAGIWSGGYTHLADSAKGRFSISRDNAKNTVYLQMNGLKPEDTAVYYCAAGLRGRQYSNWGQGTLVTVKS

SEQ ID NO: 451 - protein, 117 aa, Artificial Sequence; identical to SEQ ID NO: 450
  Nanobody sequence

SEQ ID NO: 452 - protein, 117 aa, Artificial Sequence
  Nanobody sequence
EVQLVESGGGLVQAGESLTLSCAASGRTLSAYIMGWFRQAPGKEREFVAGIWSGGYTHLADSAKGRFSISRDNAKNTVYLQMNGLKPEDTATYYCAAGLRGRQYSNWGQGTLVTVSS

SEQ ID NO: 453 - protein, 117 aa, Artificial Sequence
  Nanobody sequence
EVQLVESGGGVVQAGESLTLSCAASGRTLSAYIMGWFRQAPGKEREFVAGIWSGGYTHLADSAKGRFSISRDNAKNTVYLQMNGLKPEDTALYYCAAGLRGRQYSNWGQGTLVTVSS

SEQ ID NO: 454 - protein, 117 aa, Artificial Sequence
  Nanobody sequence
EVQLVESGGGVVQAGESLTLSCAASGRTLSAYIMGWFRQAPGKEREFVAGIWSGGYTHLADSAKGRFSISRDNAKNTVYLQMNGLKPEDTALYYCAAGLRGRQYSNWGQGTLVKVSS

SEQ ID NO: 455 - protein, 117 aa, Artificial Sequence
  Nanobody sequence
EVQLVESGGGVVQAGESLTLSCAASGRTLSAYIMGWFRQAPGKEREFVAGIWSGGYTHLADSAKGRFSISRDNAKNTVYLQMNGLKPEDTALYYCAAGLRGRQYSNWGQGTLVQVSS

SEQ ID NO: 456 - protein, 117 aa, Artificial Sequence
  Nanobody sequence
EVQLVESGGGVVQAGESLTLSCAASGRTLSAYIMGWFRQAPGKEREFVAGIWSGGYTHLADSAKGRFSISRDNAKNTVYLQMNGLKPEDTAVYYCAAGLRGRQYSNWGQGTLVKVSS

SEQ ID NO: 457 - protein, 117 aa, Artificial Sequence
  Nanobody sequence
EVQLVESGGGVVQAGESLTLSCAASGRTLSAYIMGWFRQAPGKEREFVAGIWSGGYTHLADSAKGRFSISRDNAKNTVYLQMNGLKPEDTAVYYCAAGLRGRQYSNWGQGTLVQVSS

SEQ ID NO: 458 - protein, 117 aa, Artificial Sequence
  Nanobody sequence
EVQLVESGGGVVQAGESLTLSCAASGRTLSAYIMGWFRQAPGKEREFVAGIWSGGYTHLADSAKGRFSISRDNAKNTVYLQMNGLKPEDTAVYYCAAGLRGRQYSNWGQGTLVTVKS

SEQ ID NO: 459 - protein, 117 aa, Artificial Sequence
  Nanobody sequence
EVQLVESGGGVVQAGESLTLSCAASGRTLSAYIMGWFRQAPGKEREFVAGIWSGGYTHLADSAKGRFSISRDNAKNTVYLQMNGLKPEDTAVYYCAAGLRGRQYSNWGQGTLVTVQS

SEQ ID NO: 460 - protein, 124 aa, Artificial Sequence
  Nanobody sequence
EVQLLESGGGLVQPGGSLRLSCVHSGPTFRTDTMGWFRQAPGKGREFVAAVTWNSGRINYADSVKGRFTISRDNSKNTAYLQMNSLRPEDTAVYYCAAHRFVVGGNRVEDWRYWGQGTLVTVSS

SEQ ID NO: 461 - protein, 5 aa, Artificial Sequence
  CDR sequence
TDTMG

SEQ ID NO: 462 - protein, 17 aa, Artificial Sequence
  CDR sequence
AVTWNSGRINYADSVKG

SEQ ID NO: 463 - protein, 15 aa, Artificial Sequence
  CDR sequence
HRFVVGGNRVEDWRY

SEQ ID NO: 464 - protein, 124 aa, Artificial Sequence
  Nanobody sequence
EVQLLESGGGLVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVKVSS

SEQ ID NO: 465 - protein, 124 aa, Artificial Sequence
  Nanobody sequence
EVQLLESGGGLVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVQVSS

SEQ ID NO: 466 - protein, 124 aa, Artificial Sequence
  Nanobody sequence
EVQLLESGGGLVQPGGSLRLSCVHSGPTFRTDTMGWFRQAPGKGREFVAAVTWNSGRINYADSVKGRFTISRDNSKNTAYLQMNSLRPEDTAVYYCAAHRFVVGGNRVEDWRYWGQGTLVKVSS

SEQ ID NO: 467 - protein, 124 aa, Artificial Sequence
  Nanobody sequence
EVQLLESGGGLVQPGGSLRLSCVHSGPTFRTDTMGWFRQAPGKGREFVAAVTWNSGRINYADSVKGRFTISRDNSKNTAYLQMNSLRPEDTAVYYCAAHRFVVGGNRVEDWRYWGQGTLVQVSS

SEQ ID NO: 468 - protein, 124 aa, Artificial Sequence
  Nanobody sequence
EVQLLESGGGLVQPGGSLRLSCVHSGPTFRTDTMGWFRQAPGKGREFVAAVTWNSGRINYADSVKGRFTISRDNSKNTAYLQMNSLRPEDTAVYYCAAHRFVVGGNRVEDWRYWGQGTLVTVKS

SEQ ID NO: 469 - protein, 124 aa, Artificial Sequence
  Nanobody sequence
EVQLLESGGGLVQPGGSLRLSCVHSGPTFRTDTMGWFRQAPGKGREFVAAVTWNSGRINYADSVKGRFTISRDNSKNTAYLQMNSLRPEDTAVYYCAAHRFVVGGNRVEDWRYWGQGTLVTVQS

SEQ ID NO: 470 - protein, 124 aa, Artificial Sequence
  Nanobody sequence
EVQLLESGGGLVQPGGSLRLSCVHSGPTFRTDTMGWFRQAPGKGREFVAAVTWNSGRINYADSVKGRFTISRDNSKNTATLQMNSLRPEDTAVYYCAAHRFVVGGNRVEDWRYWGQGTLVTVSS

SEQ ID NO: 471 - protein, 124 aa, Artificial Sequence
  Nanobody sequence
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVTVSS

SEQ ID NO: 472 - protein, 124 aa, Artificial Sequence
  Nanobody sequence
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVKVSS

SEQ ID NO: 473 - protein, 124 aa, Artificial Sequence
  Nanobody sequence
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVQVSS

SEQ ID NO: 474 - protein, 124 aa, Artificial Sequence
  Nanobody sequence
EVQLLESGGGVVQPGGSLRLSCVHSGPTFRTDTMGWFRQAPGKGREFVAAVTWNSGRINYADSVKGRFTISRDNSKNTAYLQMNSLRPEDTAVYYCAAHRFVVGGNRVEDWRYWGQGTLVKVSS

SEQ ID NO: 475 - protein, 124 aa, Artificial Sequence
  Nanobody sequence
EVQLLESGGGVVQPGGSLRLSCVHSGPTFRTDTMGWFRQAPGKGREFVAAVTWNSGRINYADSVKGRFTISRDNSKNTAYLQMNSLRPEDTAVYYCAAHRFVVGGNRVEDWRYWGQGTLVQVSS

SEQ ID NO: 476 - protein, 124 aa, Artificial Sequence
  Nanobody sequence
EVQLLESGGGVVQPGGSLRLSCVHSGPTFRTDTMGWFRQAPGKGREFVAAVTWNSGRINYADSVKGRFTISRDNSKNTAYLQMNSLRPEDTAVYYCAAHRFVVGGNRVEDWRYWGQGTLVTVKS

SEQ ID NO: 477 - protein, 124 aa, Artificial Sequence
  Nanobody sequence
EVQLLESGGGVVQPGGSLRLSCVHSGPTFRTDTMGWFRQAPGKGREFVAAVTWNSGRINYADSVKGRFTISRDNSKNTAYLQMNSLRPEDTAVYYCAAHRFVVGGNRVEDWRYWGQGTLVTVQS

SEQ ID NO: 478 - protein, 124 aa, Artificial Sequence
  Nanobody sequence
EVQLLESGGGLVQPGGSLRLSCAASGRTFNNYNMGWFRQAPGKGREFVAAVSRSGVSTYYADSVKGRFTISRDNSKNTVYLQMNSLRPEDTAVYYCAAAYRGTAINVRRSYSSWGQGTLVTVSS

SEQ ID NO: 479 - protein, 5 aa, Artificial Sequence
  CDR sequence
NYNMG

SEQ ID NO: 480 - protein, 17 aa, Artificial Sequence
  CDR sequence
AVSRSGVSTYYADSVKG

SEQ ID NO: 481 - protein, 15 aa, Artificial Sequence
  CDR sequence
AYRGTAINVRRSYSS

SEQ ID NO: 482 - protein, 124 aa, Artificial Sequence
  Nanobody sequence
EVQLLESGGGLVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSS

SEQ ID NO: 483 - protein, 124 aa, Artificial Sequence
  Nanobody sequence
EVQLLESGGGLVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVQVSS

SEQ ID NO: 484 - protein, 124 aa, Artificial Sequence
  Nanobody sequence
EVQLLESGGGLVQPGGSLRLSCAASGRTFNNYNMGWFRQAPGKGREFVAAVSRSGVSTYYADSVKGRFTISRDNSKNTVYLQMNSLRPEDTAVYYCAAAYRGTAINVRRSYSSWGQGTLVKVSS

SEQ ID NO: 485 - protein, 124 aa, Artificial Sequence
  Nanobody sequence
EVQLLESGGGLVQPGGSLRLSCAASGRTFNNYNMGWFRQAPGKGREFVAAVSRSGVSTYYADSVKGRFTISRDNSKNTVYLQMNSLRPEDTAVYYCAAAYRGTAINVRRSYSSWGQGTLVQVSS

SEQ ID NO: 486 - protein, 124 aa, Artificial Sequence
  Nanobody sequence
EVQLLESGGGLVQPGGSLRLSCAASGRTFNNYNMGWFRQAPGKGREFVAAVSRSGVSTYYADSVKGRFTISRDNSKNTVYLQMNSLRPEDTAVYYCAAAYRGTAINVRRSYSSWGQGTLVTVKS

SEQ ID NO: 487 - protein, 124 aa, Artificial Sequence
  Nanobody sequence
EVQLLESGGGLVQPGGSLRLSCAASGRTFNNYNMGWFRQAPGKGREFVAAVSRSGVSTYYADSVKGRFTISRDNSKNTVYLQMNSLRPEDTAVYYCAAAYRGTAINVRRSYSSWGQGTLVTVQS

SEQ ID NO: 488 - protein, 124 aa, Artificial Sequence
  Nanobody sequence
EVQLLESGGGLVQPGGSLRLSCAASGRTFNNYNMGWFRQAPGKGREFVAAVSRSGVSTYYADSVKGRFTISRDNSKNTVYLQMNSLRPEDTATYYCAAAYRGTAINVRRSYSSWGQGTLVTVSS

SEQ ID NO: 489 - protein, 124 aa, Artificial Sequence
  Nanobody sequence
EVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSS

SEQ ID NO: 490 - protein, 124 aa, Artificial Sequence
  Nanobody sequence
EVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSS

SEQ ID NO: 491 - protein, 124 aa, Artificial Sequence; identical to SEQ ID NO: 489
  Nanobody sequence

SEQ ID NO: 492 - protein, 124 aa, Artificial Sequence
  Nanobody sequence
EVQLLESGGGVVQPGGSLRLSCAASGRTFNNYNMGWFRQAPGKGREFVAAVSRSGVSTYYADSVKGRFTISRDNSKNTVYLQMNSLRPEDTAVYYCAAAYRGTAINVRRSYSSWGQGTLVKVSS

SEQ ID NO: 493 - protein, 124 aa, Artificial Sequence
  Nanobody sequence
EVQLLESGGGVVQPGGSLRLSCAASGRTFNNYNMGWFRQAPGKGREFVAAVSRSGVSTYYADSVKGRFTISRDNSKNTVYLQMNSLRPEDTAVYYCAAAYRGTAINVRRSYSSWGQGTLVQVSS

SEQ ID NO: 494 - protein, 124 aa, Artificial Sequence
  Nanobody sequence
EVQLLESGGGVVQPGGSLRLSCAASGRTFNNYNMGWFRQAPGKGREFVAAVSRSGVSTYYADSVKGRFTISRDNSKNTVYLQMNSLRPEDTAVYYCAAAYRGTAINVRRSYSSWGQGTLVTVKS

SEQ ID NO: 495 - protein, 124 aa, Artificial Sequence
  Nanobody sequence
EVQLLESGGGVVQPGGSLRLSCAASGRTFNNYNMGWFRQAPGKGREFVAAVSRSGVSTYYADSVKGRFTISRDNSKNTVYLQMNSLRPEDTAVYYCAAAYRGTAINVRRSYSSWGQGTLVTVQS

SEQ ID NO: 496 - protein, 115 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSS

SEQ ID NO: 497 - protein, 115 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSS

SEQ ID NO: 498 - protein, 115 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVKVSS

SEQ ID NO: 499 - protein, 115 aa, Artificial Sequence
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVQVSS

SEQ ID NO: 500 - protein, 115 aa, Artificial Sequence
  Nanobody sequence
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSS

SEQ ID NO: 501 - protein, 115 aa, Artificial Sequence
  Nanobody sequence
EVQLVESGGGVVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVKVSS

SEQ ID NO: 502 - protein, 115 aa, Artificial Sequence
  Nanobody sequence
EVQLVESGGGVVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVQVSS

SEQ ID NO: 503 - protein, 115 aa, Artificial Sequence
  Nanobody sequence
EVQLVESGGGVVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVKS

SEQ ID NO: 504 - protein, 115 aa, Artificial Sequence
  Nanobody sequence
EVQLVESGGGVVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVQS

SEQ ID NO: 505 - protein, 115 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSS

SEQ ID NO: 506 - protein, 115 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVQVSS

SEQ ID NO: 507 - protein, 115 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVKVSS

SEQ ID NO: 508 - protein, 115 aa, Artificial Sequence
  Nanobody sequence
EVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVQVSS

SEQ ID NO: 509 - protein, 115 aa, Artificial Sequence
  Nanobody sequence
EVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVQVSS

SEQ ID NO: 510 - protein, 115 aa, Artificial Sequence
  Nanobody sequence
EVQLLESGGGVVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVKVSS

SEQ ID NO: 511 - protein, 115 aa, Artificial Sequence
  Nanobody sequence
EVQLLESGGGVVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVQVSS

SEQ ID NO: 512 - protein, 115 aa, Artificial Sequence
  Nanobody sequence
EVQLLESGGGVVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVKS

SEQ ID NO: 513 - protein, 115 aa, Artificial Sequence
  Nanobody sequence
EVQLLESGGGVVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVQS

SEQ ID NO: 514 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVTVSSA

SEQ ID NO: 515 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVKVSSA

SEQ ID NO: 516 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVQVSSA

SEQ ID NO: 517 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVTVSSA

SEQ ID NO: 518 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVKVSSA

SEQ ID NO: 519 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVQVSSA

SEQ ID NO: 520 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVTVSSA

SEQ ID NO: 521 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVKVSSA

SEQ ID NO: 522 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVQVSSA

SEQ ID NO: 523 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVTVSSA

SEQ ID NO: 524 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVKVSSA

SEQ ID NO: 525 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVQVSSA

SEQ ID NO: 526 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVTVSSA

SEQ ID NO: 527 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVKVSSA

SEQ ID NO: 528 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVQVSSA

SEQ ID NO: 529 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVTVSSA

SEQ ID NO: 530 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVKVSSA

SEQ ID NO: 531 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVQVSSA

SEQ ID NO: 532 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVTVSSA

SEQ ID NO: 533 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVKVSSA

SEQ ID NO: 534 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVQVSSA

SEQ ID NO: 535 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVTVSSA

SEQ ID NO: 536 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVKVSSA

SEQ ID NO: 537 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVQVSSA

SEQ ID NO: 538 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVQVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVTVSSA

SEQ ID NO: 539 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVQVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVKVSSA

SEQ ID NO: 540 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVQVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVQVSSA

SEQ ID NO: 541 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVTVSSA

SEQ ID NO: 542 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVKVSSA

SEQ ID NO: 543 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVQVSSA

SEQ ID NO: 544 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVTVSSA

SEQ ID NO: 545 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVKVSSA

SEQ ID NO: 546 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVQVSSA

SEQ ID NO: 547 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVTVSSA

SEQ ID NO: 548 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVKVSSA

SEQ ID NO: 549 - protein, 387 aa, Artificial Sequence
  Nanobody construct
EVQLLESGGGVVQPGGSLRLSCAASGRIFSLPASGNIFNLLTIAWYRQAPGKGRELVATINSGSRTYYADSVKGRFTISRDNSKKTVYLQMNSLRPEDTALYYCQTSGSGSPNFWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTLSSYAMGWFRQAPGKGREFVARISQGGTAIYYADSVKGRFTISRDNSKNTLYLQMNSLRPEDTALYYCAKDPSPYYRGSAYLLSGSYDSWGQGTLVQVSSA

SEQ ID NO: 550 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSA

SEQ ID NO: 551 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSA

SEQ ID NO: 552 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSA

SEQ ID NO: 553 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSA

SEQ ID NO: 554 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSA

SEQ ID NO: 555 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSA

SEQ ID NO: 556 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSA

SEQ ID NO: 557 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSA

SEQ ID NO: 558 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSA

SEQ ID NO: 559 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSA

SEQ ID NO: 560 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSA

SEQ ID NO: 561 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSA

SEQ ID NO: 562 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSA

SEQ ID NO: 563 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSA

SEQ ID NO: 564 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSA

SEQ ID NO: 565 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSA

SEQ ID NO: 566 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSA

SEQ ID NO: 567 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSA

SEQ ID NO: 568 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSA

SEQ ID NO: 569 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSA

SEQ ID NO: 570 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSA

SEQ ID NO: 571 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSA

SEQ ID NO: 572 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSA

SEQ ID NO: 573 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSA

SEQ ID NO: 574 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSA

SEQ ID NO: 575 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSA

SEQ ID NO: 576 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSA

SEQ ID NO: 577 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSA

SEQ ID NO: 578 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSA

SEQ ID NO: 579 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSA

SEQ ID NO: 580 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSA

SEQ ID NO: 581 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSA

SEQ ID NO: 582 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSA

SEQ ID NO: 583 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVTVSSA

SEQ ID NO: 584 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVKVSSA

SEQ ID NO: 585 - protein, 368 aa, Artificial Sequence
  Nanobody construct
EVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASRSIGRLDRMGWYRHRPGEPRELVATITGGSSINYGDSVKGRFTISIDNSKNTVYLQMNSLRPEDTALYYCNFNKYVTSRDTWGQGTLVQVSSA

SEQ ID NO: 586 - protein, 247 aa, Artificial Sequence
  Nanobody construct
DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVTVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSA

SEQ ID NO: 587 - protein, 247 aa, Artificial Sequence
  Nanobody construct
DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVTVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSA

SEQ ID NO: 588 - protein, 247 aa, Artificial Sequence
  Nanobody construct
DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVTVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVQVSSA

SEQ ID NO: 589 - protein, 247 aa, Artificial Sequence
  Nanobody construct
DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVKVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSA

SEQ ID NO: 590 - protein, 247 aa, Artificial Sequence
  Nanobody construct
DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVKVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSA

SEQ ID NO: 591 - protein, 247 aa, Artificial Sequence
  Nanobody construct
DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVKVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVQVSSA

SEQ ID NO: 592 - protein, 247 aa, Artificial Sequence
  Nanobody construct
DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVQVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSA

SEQ ID NO: 593 - protein, 247 aa, Artificial Sequence
  Nanobody construct
DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVQVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSA

SEQ ID NO: 594 - protein, 247 aa, Artificial Sequence
  Nanobody construct
DVQLLESGGGVVQPGGSLRLSCAASGFTFGNYDMAWVRQAPGKRPEWVSSIDTGGDITHYADSVKGRFTISRDNAKNTLYLQMNSLRPEDTALYWCATDEEYALGPNEFDYYGQGTLVQVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVQVSSA

SEQ ID NO: 595 - protein, 271 aa, Artificial Sequence
  Nanobody construct
EVQLVESGGGVVQPGGSLRLSCAASGFTFSSYAMSWVRQAPGKGLEWVSGIKSSGDSTRYAGSVKGRFTISRDNAKNTLYLQMNSLRPEDTALYYCAKSRVSRTGLYTYDNRGQGTLVTVSSGGGGSGGGGSGGGGSGGGGSEVQLVESGGGVVQPGGSLRLSCAASGRTFNNYAMGWFRQAPGKEREFVAAITRSGVRSGVSAIYGDSVKDRFTISRDNAKNTLYLQMNSLRPEDTALYYCAASAIGSGALRRFEYDYSGQGTLVTVSSA

SEQ ID NO: 596 - protein, 271 aa, Artificial Sequence
  Nanobody construct
EVQLVESGGGVVQPGGSLRLSCAASGFTFSSYAMSWVRQAPGKGLEWVSGIKSSGDSTRYAGSVKGRFTISRDNAKNTLYLQMNSLRPEDTALYYCAKSRVSRTGLYTYDNRGQGTLVTVSSGGGGSGGGGSGGGGSGGGGSEVQLVESGGGVVQPGGSLRLSCAASGRTFNNYAMGWFRQAPGKEREFVAAITRSGVRSGVSAIYGDSVKDRFTISRDNAKNTLYLQMNSLRPEDTALYYCAASAIGSGALRRFEYDYSGQGTLVKVSSA

SEQ ID NO: 597 - protein, 271 aa, Artificial Sequence
  Nanobody construct
EVQLVESGGGVVQPGGSLRLSCAASGFTFSSYAMSWVRQAPGKGLEWVSGIKSSGDSTRYAGSVKGRFTISRDNAKNTLYLQMNSLRPEDTALYYCAKSRVSRTGLYTYDNRGQGTLVTVSSGGGGSGGGGSGGGGSGGGGSEVQLVESGGGVVQPGGSLRLSCAASGRTFNNYAMGWFRQAPGKEREFVAAITRSGVRSGVSAIYGDSVKDRFTISRDNAKNTLYLQMNSLRPEDTALYYCAASAIGSGALRRFEYDYSGQGTLVQVSSA

SEQ ID NO: 598 - protein, 271 aa, Artificial Sequence
  Nanobody construct
EVQLVESGGGVVQPGGSLRLSCAASGFTFSSYAMSWVRQAPGKGLEWVSGIKSSGDSTRYAGSVKGRFTISRDNAKNTLYLQMNSLRPEDTALYYCAKSRVSRTGLYTYDNRGQGTLVKVSSGGGGSGGGGSGGGGSGGGGSEVQLVESGGGVVQPGGSLRLSCAASGRTFNNYAMGWFRQAPGKEREFVAAITRSGVRSGVSAIYGDSVKDRFTISRDNAKNTLYLQMNSLRPEDTALYYCAASAIGSGALRRFEYDYSGQGTLVTVSSA

SEQ ID NO: 599 - protein, 271 aa, Artificial Sequence
  Nanobody construct
EVQLVESGGGVVQPGGSLRLSCAASGFTFSSYAMSWVRQAPGKGLEWVSGIKSSGDSTRYAGSVKGRFTISRDNAKNTLYLQMNSLRPEDTALYYCAKSRVSRTGLYTYDNRGQGTLVKVSSGGGGSGGGGSGGGGSGGGGSEVQLVESGGGVVQPGGSLRLSCAASGRTFNNYAMGWFRQAPGKEREFVAAITRSGVRSGVSAIYGDSVKDRFTISRDNAKNTLYLQMNSLRPEDTALYYCAASAIGSGALRRFEYDYSGQGTLVKVSSA

SEQ ID NO: 600 - protein, 271 aa, Artificial Sequence
  Nanobody construct
EVQLVESGGGVVQPGGSLRLSCAASGFTFSSYAMSWVRQAPGKGLEWVSGIKSSGDSTRYAGSVKGRFTISRDNAKNTLYLQMNSLRPEDTALYYCAKSRVSRTGLYTYDNRGQGTLVKVSSGGGGSGGGGSGGGGSGGGGSEVQLVESGGGVVQPGGSLRLSCAASGRTFNNYAMGWFRQAPGKEREFVAAITRSGVRSGVSAIYGDSVKDRFTISRDNAKNTLYLQMNSLRPEDTALYYCAASAIGSGALRRFEYDYSGQGTLVQVSSA

SEQ ID NO: 601 - protein, 271 aa, Artificial Sequence
  Nanobody construct
EVQLVESGGGVVQPGGSLRLSCAASGFTFSSYAMSWVRQAPGKGLEWVSGIKSSGDSTRYAGSVKGRFTISRDNAKNTLYLQMNSLRPEDTALYYCAKSRVSRTGLYTYDNRGQGTLVQVSSGGGGSGGGGSGGGGSGGGGSEVQLVESGGGVVQPGGSLRLSCAASGRTFNNYAMGWFRQAPGKEREFVAAITRSGVRSGVSAIYGDSVKDRFTISRDNAKNTLYLQMNSLRPEDTALYYCAASAIGSGALRRFEYDYSGQGTLVTVSSA

SEQ ID NO: 602 - protein, 271 aa, Artificial Sequence
  Nanobody construct
EVQLVESGGGVVQPGGSLRLSCAASGFTFSSYAMSWVRQAPGKGLEWVSGIKSSGDSTRYAGSVKGRFTISRDNAKNTLYLQMNSLRPEDTALYYCAKSRVSRTGLYTYDNRGQGTLVQVSSGGGGSGGGGSGGGGSGGGGSEVQLVESGGGVVQPGGSLRLSCAASGRTFNNYAMGWFRQAPGKEREFVAAITRSGVRSGVSAIYGDSVKDRFTISRDNAKNTLYLQMNSLRPEDTALYYCAASAIGSGALRRFEYDYSGQGTLVKVSSA

SEQ ID NO: 603 - protein, 271 aa, Artificial Sequence
  Nanobody construct
EVQLVESGGGVVQPGGSLRLSCAASGFTFSSYAMSWVRQAPGKGLEWVSGIKSSGDSTRYAGSVKGRFTISRDNAKNTLYLQMNSLRPEDTALYYCAKSRVSRTGLYTYDNRGQGTLVQVSSGGGGSGGGGSGGGGSGGGGSEVQLVESGGGVVQPGGSLRLSCAASGRTFNNYAMGWFRQAPGKEREFVAAITRSGVRSGVSAIYGDSVKDRFTISRDNAKNTLYLQMNSLRPEDTALYYCAASAIGSGALRRFEYDYSGQGTLVQVSSA

SEQ ID NO: 604 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVTVSSA

SEQ ID NO: 605 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVKVSSA

SEQ ID NO: 606 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVQVSSA

SEQ ID NO: 607 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVTVSSA

SEQ ID NO: 608 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVKVSSA

SEQ ID NO: 609 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVQVSSA

SEQ ID NO: 610 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVTVSSA

SEQ ID NO: 611 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVKVSSA

SEQ ID NO: 612 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVQVSSA

SEQ ID NO: 613 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVTVSSA

SEQ ID NO: 614 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVKVSSA

SEQ ID NO: 615 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVQVSSA

SEQ ID NO: 616 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVTVSSA

SEQ ID NO: 617 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVKVSSA

SEQ ID NO: 618 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVQVSSA

SEQ ID NO: 619 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVTVSSA

SEQ ID NO: 620 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVKVSSA

SEQ ID NO: 621 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVQVSSA

SEQ ID NO: 622 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVTVSSA

SEQ ID NO: 623 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVKVSSA

SEQ ID NO: 624 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVQVSSA

SEQ ID NO: 625 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVTVSSA

SEQ ID NO: 626 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVKVSSA

SEQ ID NO: 627 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVQVSSA

SEQ ID NO: 628 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVQVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVTVSSA

SEQ ID NO: 629 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVQVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVKVSSA

SEQ ID NO: 630 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVQVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVQVSSA

SEQ ID NO: 631 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVTVSSA

SEQ ID NO: 632 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVKVSSA

SEQ ID NO: 633 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVQVSSA

SEQ ID NO: 634 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVTVSSA

SEQ ID NO: 635 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVKVSSA

SEQ ID NO: 636 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVQVSSA

SEQ ID NO: 637 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVTVSSA

SEQ ID NO: 638 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVKVSSA

SEQ ID NO: 639 - protein, 377 aa, Artificial Sequence
  Nanobody construct
DVQLVESGGGVVQPGGSLRLSCAASGSIGGLNAMAWYRQAPGKERELVAGIFGVGSTRYADSVKGRFTISRDNSKNTVYLQMNSLRPEDTALYYCRMSSVTRGSSDYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGRTYYLNAMGWFRQAPGKEREFVAAIDWSEGNKDYADSVKGRFTISRDNSKNTVYLQMNSLRPEDTALYYCAADTPPWGPLIYIESYDSWGQGTLVQVSSA

SEQ ID NO: 640 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSA

SEQ ID NO: 641 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSA

SEQ ID NO: 642 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSA

SEQ ID NO: 643 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSA

SEQ ID NO: 644 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSA

SEQ ID NO: 645 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSA

SEQ ID NO: 646 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSA

SEQ ID NO: 647 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSA

SEQ ID NO: 648 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSA

SEQ ID NO: 649 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSA

SEQ ID NO: 650 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSA

SEQ ID NO: 651 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSA

SEQ ID NO: 652 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSA

SEQ ID NO: 653 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSA

SEQ ID NO: 654 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSA

SEQ ID NO: 655 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSA

SEQ ID NO: 656 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSA

SEQ ID NO: 657 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSA

SEQ ID NO: 658 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSA

SEQ ID NO: 659 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSA

SEQ ID NO: 660 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSA

SEQ ID NO: 661 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSA

SEQ ID NO: 662 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSA

SEQ ID NO: 663 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSA

SEQ ID NO: 664 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSA

SEQ ID NO: 665 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSA

SEQ ID NO: 666 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSA

SEQ ID NO: 667 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSA

SEQ ID NO: 668 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSA

SEQ ID NO: 669 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSA

SEQ ID NO: 670 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSA

SEQ ID NO: 671 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSA

SEQ ID NO: 672 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSA

SEQ ID NO: 673 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVTVSSA

SEQ ID NO: 674 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVKVSSA

SEQ ID NO: 675 - protein, 364 aa, Artificial Sequence
  Nanobody construct
EVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSDYWMYWVRQAPGKGLEWVSEINTNGLITKYPDSVKGRFTISRDNAKNTLYLQMNSLRPEDTALYYCARSPSGFNRGQGTLVQVSSA

SEQ ID NO: 676 - protein, 250 aa, Artificial Sequence
  Nanobody construct
DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVTVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSA

SEQ ID NO: 677 - protein, 250 aa, Artificial Sequence
  Nanobody construct
DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVTVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSA

SEQ ID NO: 678 - protein, 250 aa, Artificial Sequence
  Nanobody construct
DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVTVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVQVSSA

SEQ ID NO: 679 - protein, 250 aa, Artificial Sequence
  Nanobody construct
DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVKVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSA

SEQ ID NO: 680 - protein, 250 aa, Artificial Sequence
  Nanobody construct
DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVKVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSA

SEQ ID NO: 681 - protein, 250 aa, Artificial Sequence
  Nanobody construct
DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVKVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVQVSSA

SEQ ID NO: 682 - protein, 250 aa, Artificial Sequence
  Nanobody construct
DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVQVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVTVSSA

SEQ ID NO: 683 - protein, 250 aa, Artificial Sequence
  Nanobody construct
DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVQVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVKVSSA

SEQ ID NO: 684 - protein, 250 aa, Artificial Sequence
  Nanobody construct
DVQLVESGGGVVQPGGSLRLSCAASGFILDYYAIGWFRQAPGKEREGVLCIDASDDITYYADSVKGRFTISRDNSKNTVYLQMNSLRPEDTALYYCATPIGLSSSCLLEYDYDYWGQGTLVQVSSGGGGSGGGSEVQLLESGGGVVQPGGSLRLSCAASGFTFRSFGMSWVRQAPGKGPEWVSSISGSGSDTLYADSVKGRFTISRDNSKNTLYLQMNSLRPEDTALYYCTIGGSLSRSSQGTLVQVSSA

SEQ ID NO: 685 - protein, 249 aa, Artificial Sequence
  Nanobody construct
DVQLVESGGGVVQPGGSLRLSCAASGFAFDDYAIGWFRQAPGEEREGVSSISSTYGLTYYADSVKGRFTISSDNSKNTVYLQMNSLRPEDTALYYCAATPIGLIGLDAYEYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA

SEQ ID NO: 686 - protein, 249 aa, Artificial Sequence
  Nanobody construct
DVQLVESGGGVVQPGGSLRLSCAASGFAFDDYAIGWFRQAPGEEREGVSSISSTYGLTYYADSVKGRFTISSDNSKNTVYLQMNSLRPEDTALYYCAATPIGLIGLDAYEYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSA

SEQ ID NO: 687 - protein, 249 aa, Artificial Sequence
  Nanobody construct
DVQLVESGGGVVQPGGSLRLSCAASGFAFDDYAIGWFRQAPGEEREGVSSISSTYGLTYYADSVKGRFTISSDNSKNTVYLQMNSLRPEDTALYYCAATPIGLIGLDAYEYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSA

SEQ ID NO: 688 - protein, 249 aa, Artificial Sequence
  Nanobody construct
DVQLVESGGGVVQPGGSLRLSCAASGFAFDDYAIGWFRQAPGEEREGVSSISSTYGLTYYADSVKGRFTISSDNSKNTVYLQMNSLRPEDTALYYCAATPIGLIGLDAYEYDYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA

SEQ ID NO: 689 - protein, 249 aa, Artificial Sequence
  Nanobody construct
DVQLVESGGGVVQPGGSLRLSCAASGFAFDDYAIGWFRQAPGEEREGVSSISSTYGLTYYADSVKGRFTISSDNSKNTVYLQMNSLRPEDTALYYCAATPIGLIGLDAYEYDYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSA

SEQ ID NO: 690 - protein, 249 aa, Artificial Sequence
  Nanobody construct
DVQLVESGGGVVQPGGSLRLSCAASGFAFDDYAIGWFRQAPGEEREGVSSISSTYGLTYYADSVKGRFTISSDNSKNTVYLQMNSLRPEDTALYYCAATPIGLIGLDAYEYDYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSA

SEQ ID NO: 691 - protein, 249 aa, Artificial Sequence
  Nanobody construct
DVQLVESGGGVVQPGGSLRLSCAASGFAFDDYAIGWFRQAPGEEREGVSSISSTYGLTYYADSVKGRFTISSDNSKNTVYLQMNSLRPEDTALYYCAATPIGLIGLDAYEYDYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSA

SEQ ID NO: 692 - protein, 249 aa, Artificial Sequence
  Nanobody construct
DVQLVESGGGVVQPGGSLRLSCAASGFAFDDYAIGWFRQAPGEEREGVSSISSTYGLTYYADSVKGRFTISSDNSKNTVYLQMNSLRPEDTALYYCAATPIGLIGLDAYEYDYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSA

SEQ ID NO: 693 - protein, 249 aa, Artificial Sequence
  Nanobody construct
DVQLVESGGGVVQPGGSLRLSCAASGFAFDDYAIGWFRQAPGEEREGVSSISSTYGLTYYADSVKGRFTISSDNSKNTVYLQMNSLRPEDTALYYCAATPIGLIGLDAYEYDYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSA

SEQ ID NO: 694 - protein, 386 aa, Artificial Sequence
  Nanobody construct
EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSA

SEQ ID NO: 695 - protein, 386 aa, Artificial Sequence
  Nanobody construct
EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVKVSSA

SEQ ID NO: 696 - protein, 386 aa, Artificial Sequence
  Nanobody construct
EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVQVSSA

SEQ ID NO: 697 - protein, 386 aa, Artificial Sequence
  Nanobody construct
EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSA

SEQ ID NO: 698 - protein, 386 aa, Artificial Sequence
  Nanobody construct
EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVKVSSA

SEQ ID NO: 699 - protein, 386 aa, Artificial Sequence
  Nanobody construct
EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVQVSSA

SEQ ID NO: 700 - protein, 386 aa, Artificial Sequence
  Nanobody construct
EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSA

SEQ ID NO: 701 - protein, 386 aa, Artificial Sequence
  Nanobody construct
EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVKVSSA

SEQ ID NO: 702 - protein, 386 aa, Artificial Sequence
  Nanobody construct
EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVQVSSA

SEQ ID NO: 703 - protein, 386 aa, Artificial Sequence
  Nanobody construct
EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSA

SEQ ID NO: 704 - protein, 386 aa, Artificial Sequence
  Nanobody construct
EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVKVSSA

SEQ ID NO: 705 - protein, 386 aa, Artificial Sequence
  Nanobody construct
EVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVQVSSA

SEQ ID NO: 706 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSA

SEQ ID NO: 707 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVKVSSA

SEQ ID NO: 708 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVQVSSA

SEQ ID NO: 709 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSA

SEQ ID NO: 710 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVKVSSA

SEQ ID NO: 711 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVQVSSA

SEQ ID NO: 712 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSA

SEQ ID NO: 713 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVKVSSA

SEQ ID NO: 714 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVQVSSA

SEQ ID NO: 715 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSA

SEQ ID NO: 716 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVKVSSA

SEQ ID NO: 717 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVQVSSA

SEQ ID NO: 718 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSA

SEQ ID NO: 719 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVKVSSA

SEQ ID NO: 720 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVQVSSA

SEQ ID NO: 721 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSA

SEQ ID NO: 722 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVKVSSA

SEQ ID NO: 723 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVQVSSA

SEQ ID NO: 724 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSA

SEQ ID NO: 725 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVKVSSA

SEQ ID NO: 726 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVQVSSA

SEQ ID NO: 727 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVTVSSA

SEQ ID NO: 728 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVKVSSA

SEQ ID NO: 729 - protein, 375 aa, Artificial Sequence
  Nanobody construct
EVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLVESGGGVVQPGGSLRLSCAASGFTFSSYPMGWFRQAPGKGREFVSSITGSGGSTYYADSVKGRFTISRDNAKNTLYLQMNSLRPEDTALYYCAAYIRPDTYLSRDYRKYDYWGQGTLVQVSSA

SEQ ID NO: 730 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA

SEQ ID NO: 731 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA

SEQ ID NO: 732 - protein, 382 aa, Artificial Sequence; identical to SEQ ID NO: 730
  Nanobody construct

SEQ ID NO: 733 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA

SEQ ID NO: 734 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA

SEQ ID NO: 735 - protein, 382 aa, Artificial Sequence; identical to SEQ ID NO: 733
  Nanobody construct

SEQ ID NO: 736 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA

SEQ ID NO: 737 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA

SEQ ID NO: 738 - protein, 382 aa, Artificial Sequence; identical to SEQ ID NO: 736
  Nanobody construct

SEQ ID NO: 739 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA

SEQ ID NO: 740 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVTVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA

SEQ ID NO: 741 - protein, 382 aa, Artificial Sequence; identical to SEQ ID NO: 739
  Nanobody construct

SEQ ID NO: 742 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA

SEQ ID NO: 743 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVKVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA

SEQ ID NO: 744 - protein, 382 aa, Artificial Sequence; identical to SEQ ID NO: 742
  Nanobody construct

SEQ ID NO: 745 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA

SEQ ID NO: 746 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA

SEQ ID NO: 747 - protein, 382 aa, Artificial Sequence; identical to SEQ ID NO: 745
  Nanobody construct

SEQ ID NO: 748 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA

SEQ ID NO: 749 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA

SEQ ID NO: 750 - protein, 382 aa, Artificial Sequence; identical to SEQ ID NO: 748
  Nanobody construct

SEQ ID NO: 751 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA

SEQ ID NO: 752 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVKVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA

SEQ ID NO: 753 - protein, 382 aa, Artificial Sequence; identical to SEQ ID NO: 751
  Nanobody construct

SEQ ID NO: 754 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVQVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA

SEQ ID NO: 755 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVQVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA

SEQ ID NO: 756 - protein, 382 aa, Artificial Sequence; identical to SEQ ID NO: 754
  Nanobody construct

SEQ ID NO: 757 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA

SEQ ID NO: 758 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVTVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA

SEQ ID NO: 759 - protein, 382 aa, Artificial Sequence; identical to SEQ ID NO: 757
  Nanobody construct

SEQ ID NO: 760 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA

SEQ ID NO: 761 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVKVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA

SEQ ID NO: 762 - protein, 382 aa, Artificial Sequence; identical to SEQ ID NO: 760
  Nanobody construct

SEQ ID NO: 763 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVTVSSA

SEQ ID NO: 764 - protein, 382 aa, Artificial Sequence
  Nanobody construct
EVQLLESGGGVVQPGGSLRLSCVHSGPTFRTDTMGWFRQAPGKGREFVAAVTWNSGRINYADSVKGRFTISRDNSKNTALLQMNSLRPEDTAVYYCAAHRFVVGGNRVEDWRYWGQGTLVQVSSGGGGSGGGSEVQLVESGGGVVQPGNSLRLSCAASGFTFSSFGMSWVRQAPGKGLEWVSSISGSGSDTLYADSVKGRFTISRDNAKTTLYLQMNSLRPEDTALYYCTIGGSLSRSSQGTLVQVSSGGGGSGGGSEVQLLESGGGVVQPGGSLRLSCAASGRTFNNYNMGWFRQAPGKGREFVAAVSRSGVSTYYADSVKGRFTISRDNSKNTVYLQMNSLRPEDTALYYCAAAYRGTAINVRRSYSSWGQGTLVKVSSA

SEQ ID NO: 765 - protein, 382 aa, Artificial Sequence; identical to SEQ ID NO: 763
  Nanobody construct

SEQ ID NO: 766 - protein, 382 aa, Artificial Sequence
  Nanobody construct
EVQLLESGGGLVQPGGSLRLSCVHSGPTFRTDTMGWFRQAPGKGREFVAAVTWNSGRINYADSVKGRFTISRDNSKNTAYLQMNSLRPEDTAVYYCAAHRFVVGGNRVEDWRYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLLESGGGLVQPGGSLRLSCAASGRTFNNYNMGWFRQAPGKGREFVAAVSRSGVSTYYADSVKGRFTISRDNSKNTVYLQMNSLRPEDTAVYYCAAAYRGTAINVRRSYSSWGQGTLVTVSSA

The invention claimed is:

1. A nucleic acid encoding a heavy chain immunoglobulin single variable domain (ISVD), and wherein the heavy chain ISVD comprises a C-terminal sequence (Kabat positions 109 to 113) that is VTVKS (SEQ ID NO:1) or VTVQS (SEQ ID NO:2), or a sequence that has one amino acid difference at one of Kabat positions 109, 110, 111 or 113 with either the sequence VTVKS (SEQ ID NO: 1) and/or VTVQS (SEQ ID NO: 2) and that still has either the amino acid residue K or Q at Kabat position 112.

2. The nucleic acid of claim 1, wherein the heavy chain ISVD comprises: a CDR1 having the amino acid sequence SFGMS (SEQ ID NO:41); a CDR2 having the amino acid sequence SISGSGSDTLYADSVKG (SEQ ID NO:42); and a CDR3 having the amino acid sequence GGSLSR (SEQ ID NO:43).

3. The nucleic acid of claim 1, wherein the heavy chain ISVD comprises an amino acid residue S, T, A, L, P, F, E, or V at Kabat position 113.

4. A nucleic acid encoding a heavy chain immunoglobulin single variable domain (ISVD), wherein the heavy chain ISVD comprises an amino acid residue E at Kabat position 11 and an amino acid residue K at Kabat position 112.

5. The nucleic acid of claim 4, wherein the heavy chain ISVD comprises an amino acid residue L at Kabat position 108.

6. The nucleic acid of claim 4, wherein the heavy chain ISVD comprises an amino acid residue S, T, A, L, P, F, E, or V at Kabat position 113.

7. The nucleic acid of claim 4, wherein the heavy chain ISVD is a VHH domain, a humanized VHH domain or a camelized VH domain.

8. A nucleic acid encoding a heavy chain immunoglobulin single variable domain (ISVD), wherein the heavy-chain ISVD comprises an amino acid residue K or Q at Kabat position 112, and wherein the heavy chain ISVD has a framework 4 (FW4 sequence) that is either:

a) one of the FW4 sequences of SEQ ID NOs: 3 to 5, 7 to 14, 16 to 20; or b) a sequence that has no more than three amino acid differences with at least one of the FW4 sequences of SEQ ID NOs 3 to 5, 7 to 14, 16 to 20, in which the amino acid residue at Kabat position 112 is K or Q.

9. The nucleic acid of claim 8, wherein the heavy chain ISVD has a FW4 sequence that is either:

a) WGQGTQVTVKS (SEQ ID NO:3) or WGQGTQVTVQS (SEQ ID NO:12); or b) a sequence that has no more than three amino acid differences with SEQ ID NO:3 and/or SEQ ID NO: 12, in which the amino acid residue at Kabat position 112 is K or Q.

10. The nucleic acid of claim 8, wherein the heavy chain ISVD has a framework 4 (FW4 sequence) that is one of the FW4 sequences of SEQ ID NOs: 3 to 5, 7 to 14, or 16 to 20.

11. The nucleic acid of claim 10, wherein the heavy chain ISVD has a FW4 sequence that is WGQGTQVTVKS (SEQ ID NO:3) or WGQGTQVTVQS (SEQ ID NO:12).

12. A nucleic acid encoding a polypeptide, wherein the polypeptide comprises a heavy chain immunoglobulin single variable domain (ISVD) linked at its C-terminal end to another immunoglobulin single variable domain, wherein the heavy-chain ISVD comprises an amino acid residue K or Q at Kabat position 112.

* * * * *